(12) United States Patent
Wijnholds et al.

(10) Patent No.: US 11,246,947 B2
(45) Date of Patent: Feb. 15, 2022

(54) RECOMBINANT AAV-CRUMBS HOMOLOGUE COMPOSITION AND METHODS FOR TREATING LCA-8 AND PROGRESSIVE RP

(71) Applicant: Academisch Ziekenhuis Leiden H.O.D.N. Leids Universitair Medisch Centrum, Leiden (NL)

(72) Inventors: Jan Wijnholds, Amsterdam (NL); Lucie Pierrette Francoise Pellissier, Tours (FR)

(73) Assignee: Academisch Ziekenhuis Leiden H.O.D. N. Leids Universitair Medisch Centrum, Leiden (NL)

( * ) Notice: Subject to any disclaimer, the term of this patent is extended or adjusted under 35 U.S.C. 154(b) by 234 days.

(21) Appl. No.: 14/910,302

(22) PCT Filed: Aug. 5, 2014

(86) PCT No.: PCT/NL2014/050549
§ 371 (c)(1),
(2) Date: Feb. 5, 2016

(87) PCT Pub. No.: WO2015/020522
PCT Pub. Date: Feb. 12, 2015

(65) Prior Publication Data
US 2016/0194374 A1 Jul. 7, 2016

(30) Foreign Application Priority Data
Aug. 5, 2013 (EP) ..................................... 13179254

(51) Int. Cl.
| | | |
|---|---|---|
| A61K 48/00 | (2006.01) | |
| C07K 14/47 | (2006.01) | |
| C12N 15/86 | (2006.01) | |
| C12N 15/864 | (2006.01) | |
| C07K 14/705 | (2006.01) | |
| A61K 35/76 | (2015.01) | |

(52) U.S. Cl.
CPC ........ *A61K 48/005* (2013.01); *A61K 48/0075* (2013.01); *C07K 14/47* (2013.01); *C07K 14/705* (2013.01); *C12N 15/86* (2013.01); *C12N 15/8645* (2013.01); *A61K 35/76* (2013.01); *C12N 2750/14132* (2013.01); *C12N 2750/14143* (2013.01); *C12N 2750/14171* (2013.01)

(58) Field of Classification Search
CPC .. A61K 48/005; A61K 48/0075; C12N 15/86; C12N 15/8645; C12N 2750/14171; C12N 2750/14143; C07K 14/47; C07K 14/705
USPC ...................... 514/44 R; 424/199.1; 530/350
See application file for complete search history.

(56) References Cited

U.S. PATENT DOCUMENTS

| | | |
|---|---|---|
| 4,745,051 A | 5/1988 | Smith et al. |
| 6,103,526 A | 8/2000 | Smith et al. |
| 2003/0148506 A1 | 8/2003 | Kotin et al. |

FOREIGN PATENT DOCUMENTS

| | | |
|---|---|---|
| WO | 00/28004 A1 | 5/2000 |
| WO | 03/074714 A1 | 9/2003 |
| WO | 2011/133933 A2 | 10/2011 |
| WO | 2012/114090 A1 | 8/2012 |

OTHER PUBLICATIONS

Mitsuishi et al. (2010) J. Biol. Chemn., vol. 285(20), 14920-14931.*
Alves et al. (2012-Advance Access publication) Human Molecular Genetics (2013) vol. 22(1), 35-50.*
Ellis et al. (Mar. 6, 2013) Virology Journal, vol. 10-74, pp. 1-10.*
Uniprot Accession No. Q51J48, submitted Jul. 2005.*
Maguire et al. (2012) Mol. Ther., vol. 20(5), 960-971.*
Kay et al. (2013) PLoS ONE, vol. 8(4), e62097, pp. 1-12.*
Klimczak et al. (2009) PLoS ONE, vol. 4(10), e7467.*
Watanabe et al. (2013) PLoS ONE, vol. 8(1), e54146, pp. 1-12.*
Lebherz et al. (2008) J. Gene Med., vol. 10(4), 375-382: https://doi.org/10.1002 /jgm.1126, pp. 1-17.*
Nayerossadat et al. (2012) Adv. Biomed. Res., vol. 1(2), 1-15.*
Omori, Y., et al., "oko meduzy and Related Crumbs Genes Are Determinants of Apical Cell Features in the Vertebrate Embryo," Current Biology, May 2006, pp. 945-957, vol. 16, No. 10.
Pang, J., et al., "Long-Term Retinal Function and Structure Rescue Using Capsid Mutant AAV8 Vector in the rd10 Mouse, A Model of Recessive Retinits Pigmentosa," Molecular Therapy, Feb. 2011, pp. 234-242, vol. 19, No. 2.
Pang, J., et al., "Gene Therapy Restores Vision-Dependent Behavior as Well as Retinal Structure and Function in a Mouse Model of RPE65 Leber Congenital Amaurosis," Molecular Therapy, Mar. 2006, pp. 565-572, vol. 13, No. 3.
Pang, J., et al., "Self-Complementary AAV-Mediated Gene Therapy Restores Cone Function and Prevents Cone Degeneration in Two Models of Rpe65 Deficiency," Gene Therapy, Jul. 2010, pp. 815-826, vol. 17, No. 7.
Park, B., et al., "PALS1 is Essential for Retinal Pigment Epithelium Structure and Neural Retina Stratification," The Journal of Neuroscience, Nov. 2011, p. 17230-17241, vol. 31, No. 47.
Park, T. W., et al., "Intravitreal Delivery of AAV8 Retinoschisin Results in Cell Type-Specific Gene Expression and Retinal Rescue in the Rs1-KO Mouse," Gene Therapy, Jul. 2009, pp. 916-926, vol. 16, No. 7.

(Continued)

*Primary Examiner* — Anne Marie S Wehbe
(74) *Attorney, Agent, or Firm* — Stinson LLP

(57) ABSTRACT

The present invention relates to a Crumbs homologue (CRB) therapeutic for use as a medicament or in a method of treatment or prophylaxis, for example in the treatment or prophylaxis of a retinal disorder due to mutations in the Crumbs homologue-1 (CRB1) gene, such as Leber's congenital amaurosis 8 (LCA8) or retinitis pigmentosa 12 (RP12). In particular, the present invention relates to a recombinant viral vector comprising CRB2 or modified non-toxic forms of either CRB1 or CRB3 that resemble CRB2.

4 Claims, 20 Drawing Sheets

Specification includes a Sequence Listing.

(56) References Cited

OTHER PUBLICATIONS

Pasadhika, S., et al., "Differential Macular Morphology in Patients with RPE65-, CEP290-, GUCY2D-, and AIPL1-Related Leber Congenital Amaurosis," Investigative Ophthalmology & Visual Science, May 2010, pp. 2608-2614, vol. 51, No. 5.
Pawlyk, B. S., et al., "Gene Replacement Therapy Rescues Photoreceptor Degeneration in A Murine Model of Leber Congenital Amaurosis Lacking RPGRIP," Investigative Ophthalmology & Visual Science, Sep. 2005, pp. 3039-3045, vol. 46, No. 9.
Pawlyk, B. S., et al., "Replacement Gene Therapy With a Human RPGRIP1 Sequence Slows Photoreceptor Degeneration in a Murine Model of Leber Congenital Amaurosis," Human Gene Therapy, Aug. 2010, pp. 993-1004, vol. 21, No. 8.
Pellikka, M., et al., "Crumbs, The *Drosophila* Homologue of Human CRB1/RP12, Is Essential for Photoreceptor Morphogenesis," Nature, 2002, pp. 143-149, vol. 416, No. 6877.
Pellissier, L. P., et al., "Targeted Ablation of Crb1 and Crb2 in Retinal Progenitor Cells Mimics Leber Congenital Amaurosis," PLOS Genetics, Dec. 2013, 15 Pages, e1003976, vol. 9, Issue 12.
Pellissier, L. P., et al., "CRB2 Acts as a Modifying Factor of CRB1-Related Retinal Dystrophies in Mice," Human Molecular Genetics, 2014, pp. 3759-3771, vol. 23, No. 14.
Pellissier, L. P., et al., "Specific Tools for Targeting and Expression in Muller Glial Cells," Molecular Therapy-Methods & Clinical Development, 2014, 9 Pages, vol. 1.
Perrault, I., et al., "Leber Congenital Amaurosis," Molecular Genetics and Metabolism, Oct. 1999, pp. 200-208, vol. 68, No. 2.
Petersen-Jones, S. M., "Viral Vectors for Targeting the Canine Retina: A Review," Veterinary Ophthalmology, 2012, pp. 29-34, vol. 15, Supplement 2.
Petit, L., et al., "Restoration of Vision in the pde6Beta-Deficient Dog, A Large Animal Model of Rod-Cone Dystrophy," Molecular Therapy, Nov. 2012, pp. 2019-2030, vol. 20, No. 11.
Provost, N., et al., "Biodistribution of rAAV Vectors Following Intraocular Administration: Evidence for the Presence and Persistence of Vector DNA in the Optic Nerve and in the Brain," Molecular Therapy, Feb. 2005, pp. 275-283, vol. 11, No. 2.
Rapti, K., et al., "Neutralizing Antibodies Against AAV Serotypes 1,2, 6, and 9 in Sera of Commonly Used Animal Models," Molecular Therapy, Jan. 2012, pp. 73-83, vol. 20, No. 1.
Richard, M., et al., "Towards Understanding CRUMBS Function in Retinal Dystrophies," Human Molecular Genetics, 2006, pp. R235-R243, vol. 15, Review Issue No. 2.
Roh, M. H., et al., "The Maguk Protein, Palsl, Functions as an Adapter, Linking Mammalian Homologues of Crumbs and Discs Lost," The Journal of Cell Biology, Apr. 2002, pp. 161-172, vol. 157, No. 1.
Rolling, F., "Gene Therapeutic Prospects in Early Onset of Severe Retinal Dystrophy: Restoration of Vision in RPE65 Briard Dogs Using an AAV Serotype 4 Vector that Specifically Targets the Retinal Pigmented Epithelium," Bulletin et Memoires de l'Academie Royale de Medecine de Belgique, 2006, pp. 497-508, vol. 161, Nos. 10-12.
Salegio, E. A., et al., "Axonal Transport of Adeno-Associated Viral Vectors is Serotype-Dependent," Gene Therapy, 2013, pp. 348-352, vol. 20, No. 3.
Schappert-Kimmijser, J., et al., "Amaurosis Congenita (Leber)," A. M. A. Archives of Ophthalmology, Feb. 1959, pp. 59/211-66/218, vol. 61, No. 2.
Schroeder, R., et al., "Leber's Congenital Amaurosis. Retrospective Review of 43 Cases and a New Fundus Finding in Two Cases," Archives of Ophthalmology, Mar. 1987, pp. 356-359, vol. 105, No. 3.
Schuil, J., et al., "Mental Retardation in Amaurosis Congenita of Leber," Neuropediatrics, Dec. 1998, pp. 294-297, vol. 29, No. 6.
Simonelli, F., et al., "Clincal and Molecular Genetics of Leber's Congenital Amaurosis: A Multicenter Study of Italian Patients," Investigative Ophthalmology and Visual Science, Sep. 2007, pp. 4284-4290, vol. 48, No. 9.

Simonelli, F., et al., "Gene Therapy for Leber's Congenital Amaurosis is Safe and Effective Through 1.5 Years After Vector Administration," Molecular Therapy, Mar. 2010, pp. 643-650, vol. 18, No. 3.
Stieger, K., "Gene Therapy for Vision Loss-Recent Developments," Discovery Medicine, Nov. 2010, pp. 425-433, vol. 10, No. 54.
Stieger, K., et al., "Subretinal Delivery of Recombinant AAV Serotype 8 Vector in Dogs Results in Gene Transfer to Neurons in the Brain," Molecular Therapy, May 2008, pp. 916-923, vol. 16, No. 5.
Stieger, K., et al., "Detection of Intact rAAV Particles Up to 6 Years After Successful Gene Transfer in the Retina of Dogs and Primates," Molecular Therapy, Mar. 2009, pp. 516-523, vol. 17, No. 3.
Stieger, K., et al., "Adeno-Associated Virus Mediated Gene Therapy for Retinal Degenerative Diseases," Methods in Molecular Biology, Chapter 8, 2011, pp. 179-218, vol. 807.
Sun, X., et al., "Gene Therapy with a Promoter Targeting Both Rods and Cones Rescues Retinal Degeneration Caused by AIPL1 Mutations," Gene Therapy, Jan. 2010, pp. 117-131, vol. 17, No. 1.
Sundaram, V., et al., "Retinal Dystrophies and Gene Therapy," European Journal of Pediatrics, 2012, pp. 757-765, vol. 171, No. 5.
Surace, E. M., et al., "Versatility of AAV Vectors for Retinal Gene Transfer," Vision Research, 2008, pp. 353-359, vol. 48, No. 3.
Tan, M. H., et al., "Gene Therapy for Retinitis Pigmentosa and Leber Congenital Amaurosis Caused by Defects in AIPL1: Effective Rescue of Mouse Models of Partial and Complete Aipl1 Deficiency Using AAV2/2 and AAV2/8 Vectors," Human Molecular Genetics, 2009, pp. 2099-2114, vol. 18, No. 12.
Tanimoto, N., et al., "Functional Phenotyping of Mouse Models with ERG," Methods in Molecular Biology, Chapter 4, 2013, pp. 69-78, vol. 935.
Testa, F., et al., "Three Year Follow-Up after Unilaterial Subretinal Delivery of Adeno-Associated Virus in Patients with Leber Congenital Amaurosis Type 2," Ophthalmology, Jun. 2013, pp. 1283-1291, vol. 120, No. 6.
Timmers, A. M., et al., "Subretinal Injections in Rodent Eyes: Effects on Electrophysiology and Histology of Rat Retina," Molecular Vision, 2000, pp. 131-137, vol. 7.
Vallespin, E., et al., "Mutation Screening of 299 Spanish Families with Retinal Dystrophies by Leber Congenital Amaurosis Genotyping Microarray," Investigative Ophthalmology and Visual Science, Dec. 2007, pp. 5653-5661, vol. 48, No. 12.
Van De Pavert, S. A., et al., "A Single Amino Acid Substitution (Cys249Trp) in Crb1 Causes Retinal Degeneration and Deregulates Expression of Pituitary Tumor Transforming Gene Pttgl," The Journal of Neuroscience, Jan. 2007, pp. 564-573, vol. 27, No. 3.
Van De Pavert, S. A.,et al., "Crumbs Homologue 1 is Required for Maintenance of Photoreceptor Cell Polarization and Adhesion During Light Exposure," Journal of Cell Science, Aug. 2004, pp. 4169-4177, vol. 117, Part 18.
Van De Pavert, S. A., et al., "Crb1 is a Determinant of Retinal Apical Muller Glia Cell Features," Glia, Nov. 2007, pp. 1486-1497, vol. 55, No. 14.
Van Den Hurk, J. A. J. M., et al., "Characterization of the Crumbs homolog 2 (CRB2) Gene and Analysis of its Role in Retinitis Pigmentosa and Leber Congenital Amaurosis," Molecular Vision, 2005, pp. 263-273, vol. 11.
Van Rossum, A. G. S. H., et al., "Pals1/Mpp5 is Required for Correct Localization of Crb1 at the Subapical Region in Polarized Muller Glia Cells," Human Molecular Genetics, 2006, pp. 2659-2672, vol. 15, No. 18.
Walia, S., et al., "Visual Acuity in Patients with Leber's Congenital Amaurosis and Early Childhood-Onset Retinitis Pigmentosa," Ophthalmology, 2010, pp. 1190-1198, vol. 117, No. 6.
Watkins, K. E., et al., "Language Networks in Anophthalmia: Maintained Hierarchy of Processing in 'Visual' Cortex," Brain, A Journal of Neurology, 2012, pp. 1566-1577, vol. 135, Part 5.
Wijnholds, J., et al., "AAV6 for Transduction of Human and Mouse Muller Glia Cells," Glia, Poster Abstracts, Oct. 2009, Abstract No. P-278, p. S93.
Yang, G. S., et al., "Virus-Mediated Transduction of Murine Retina with Adeno-Associated Virus: Effects of Viral Capsid and Genome Size," Journal of Virology, Aug. 2002, pp. 7651-7660, vol. 76, No. 15.

(56) References Cited

OTHER PUBLICATIONS

Yin, L., et al., "Intravitreal Injection of AAV2 Transduces Macaque Inner Retina," Investigative Ophthalmology and Visual Science, Apr. 2011, pp. 2775-2783, vol. 52, No. 5.

Yzer, S., et al., "CRB1 Heterozygotes with Regional Retinal Dysfunction: Implications for Genetic Testing of Leber Congenital Amaurosis," Investigative Ophthalmology and Visual Science, Sep. 2006, pp. 3736-3744, vol. 47, No. 9.

Zernant, J., et al., "Genotyping Microarray (Disease Chip) for Leber Congenital Amaurosis: Detection of Modifier Alleles," Investigative Ophthalmology and Visual Science, Sep. 2005, pp. 3052-3059, vol. 46, No. 9.

Zhong, L., et al., "Next Generation of Adeno-Associated Virus 2 Vectors: Point Mutations in Tyrosines Lead to High-Efficiency Transduction at Lower Doses," Proceedings of the National Academy of Sciences of the United States of America, Jun. 2008, pp. 7827-7832, vol. 105, No. 22.

Zhong, L., et al., "Tyrosine Phosphorylation of AAV2 Vectors and Its Consequences on Viral Intracellular Trafficking and Transgene Expression," Virology, Nov. 2008, pp. 194-202, vol. 381, No. 2.

Zolotukhin, S., et al., "Recombinant Adeno-Associated Virus Purification Using Novel Methods Improves Infectious Titer and Yield," Gene Therapy, Jun. 1999, pp. 973-985, vol. 6, No. 6.

Zolotukhin, S., et al., "Production and Purification of Serotype 1, 2, and 5 Recombinant Adeno-Associated Viral Vectors," Methods, Oct. 2002, pp. 158-167, vol. 28, No. 2.

International Search Report and Written Opinion issued for PCT/NL2014/050549, dated Dec. 1, 2014, 9 pages.

Fischer, M. D., et al., Noninvasive, In Vivo Assessment of Mouse Retinal Structure Using Optical Coherence Tomography, PLoS One, Oct. 2009, 7 Pages, e7507, vol. 4, Issue 10.

Galvin, J. A., et al., "Clinical Phenotypes in Carriers of Leber Congenital Amaurosis Mutations," Ophthalmology, Feb. 2005, pp. 349-356, vol. 112, No. 2.

Gao, G., et al., "Transendocardial Delivery of AAV6 Results in Highly Efficient and Global Cardiac Gene Transfer in Rhesus Macaques," Human Gene Therapy, Aug. 2011, pp. 979-984, vol. 22, No. 8.

Gerber, S., et al., "A Novel Mutation Disrupting the Cytoplasmic Domain of CRB1 in a Large Consanguineous Family of Palestinian Origin Affected with Leber Congenital Amaurosis," Ophthalmic Genetics, 2002, pp. 225-235, vol. 23, No. 4.

Gillespie, F. D., "Congenital Amaurosis of Leber," American Journal of Ophthalmology, May 1966, pp. 874-880, vol. 61, No. 5, Part 1.

Glushakova, L. G., et al., "Does Recombinant Adeno-Associated Virus-Vectored Proximal Region of Mouse Rhodopsin Promoter Support Only Rod-Type Specific Expression In vivo?" Molecular Vision, 2006, pp. 298-309, vol. 12.

Gosens, I., et al., "Composition and Function of the Crumbs Protein Complex in the Mammalian Rentina," Experimental Eye Research, 2008, pp. 713-726, vol. 86, No. 5.

Hanein, S., et al., "Leber Congenital Amaurosis: Comprehensive Survey of the Genetic Heterogeneity, Refinement of the Clinical Definition, and Genotype-Phenotype Correlations as a Strategy for Molecular Diagnosis," Human Mutation, 2004, pp. 306-317, vol. 23, No. 4.

Hanein, S., et al., "Leber Congenital Amaurosis: Survey of the Genetic Heterogeneity, Refinement of the Clinical Definition and Phenotype-Genotype Correlations as a Strategy for Molecular Diagnosis, Clinical and Molecular Survey in LCA," Chapter 13, Advances in Experimental Medicine and Biology, 2006, pp. 15-20, vol. 572.

Hauswirth, W. W., et al., "Treatment of Leber Congenital Amaurosis Due to RPE65 Mutations by Ocular Subretinal Injection of Adeno-Associated Virus Gene Vector: Short-Term Results of a Phase I Trial," Human Gene Therapy, Oct. 2008, pp. 979-990, vol. 19, No. 10.

Heckenlively, J. R., "Preserved Para-Arteriole Retinal Pigment Epithelium (PPRPE) in Retinitis Pigmentosa," British Journal of Ophthalmology, 1982, pp. 26-30, vol. 66, No. 1.

Henderson, R. H. H., et al., "Phenotypic Variability in Patients With Retinal Dystrophies Due to Mutations in CRB1," British Journal of Ophthalmology, 2010, pp. 811-817, vol. 95, No. 6.

Hermens, W. T. J. M. C., et al., "Purification of Recombinant Adeno-Associated Virus by Iodixanol Gradient Ultracentrifugation Allows Rapid and Reproducible Preparation of Vector Stocks for Gene Transfer in the Nervous System," Human Gene Therapy, Jul. 1999, pp. 1885-1891, vol. 10, No. 11.

Hsu, Y.-C., et al., "Multiple Domains in the Crumbs Homolog 2a (Crb2a) Protein Are Required For Regulating Rod Photoreceptor Size," BMC Cell Biology, 2010, 16 Pages, vol. 11, No. 60.

Izaddoost, S., et al., "*Drosophila* Crumbs is a Positional Cue in Photoreceptor Adherens Junctions and Rhabdomeres," Nature, Mar. 2002, pp. 178-183, vol. 416, No. 6877.

Jacobson, S. G., et al., "Safety in Nonhuman Primates of Ocular AAV2-RPE65, A Candidate Treatment for Blindness in Leber Congenital Amaurosis," Human Gene Therapy, Aug. 2006, pp. 845-858, vol. 17.

Jacobson, S. G., et al., "Gene Therapy for Leber Congenital Amaurosis Caused by RPE65 Mutations: Safety and Efficacy in Fifteen Children and Adults Followed up to Three Years," Archives of Ophthalmology, Jan. 2012, pp. 9-24, vol. 130, No. 1.

Jacobson, S. G., et al., "Crumbs Homolog 1 (CRB1) Mutations Result in A Thick Human Retina With Abnormal Lamination," Human Molecular Genetics, 2003, pp. 1073-1078, vol. 12, No. 9.

Jacobson, S. G., et al., "Safety of Recombinant Adeno-Associated Virus Type 2-RPE65 Vector Delivered by Ocular Subretinal Injection," Molecular Therapy, Jun. 2006, pp. 1074-1084, vol. 13, No. 6.

Jacobson, S. G., et al., "Photoreceptor Layer Topography in Children with Leber Congenital Amaurosis Caused by RPE65 Mutations," Investigative Ophthalmology & Visual Science, Oct. 2008, pp. 4573-4577, vol. 49, No. 10.

Kantardzieva, A., et al., "MPP5 Recruits MPP4 to the CRB1 Complex in Photoreceptors," Investigative Ophthalmology & Visual Science, Jun. 2005, pp. 2192-2201, vol. 46, No. 6.

Karali, M., et al., "MicroRNA-Restricted Transgene Expression in the Retina," PLoS One, Jul. 2011, 11 Pages, e22166, vol. 6, Issue 7.

Khani, S. C., et al., "AAV-Mediated Expression Targeting of Rod and Cone Photoreceptors with a Human Rhodopsin Kinase Promoter," Investigative Ophthalmology & Visual Science, Sep. 2007, pp. 3954-3961, vol. 48, No. 9.

Klimczak, R. R., et al., "A Novel Adeno-Associated Viral Variant for Efficient and Selective Intravitreal Transduction of Rat Muller Cells," PLoS One, Oct. 2009, 10 Pages, e7467, vol. 4, Issue 10.

Koenekoop, R. K., "An Overview of Leber Congenital Amaurosis: A Model to Understand Human Retinal Development," Survey of Ophthalmology, Jul.-Aug. 2004, pp. 379-398, vol. 49, No. 4.

Kolstad, K. D., et al., "Changes in Adeno-Associated Virus-Mediated Gene Delivery in Retinal Degeneration," Human Gene Therapy, May 2010, pp. 571-578, vol. 21, No. 5.

Komaromy, A. M., et al., "Gene Therapy Rescues Cone Function in Congenital Achromatopsia," Human Molecular Genetics, 2010, pp. 2581-2593, vol. 19, No. 13.

Kotin, R. M., "Prospects for the Use of Adeno-Associated Virus as a Vector for Human Gene Therapy," Human Gene Therapy, 1994, pp. 793-801, vol. 5, No. 7.

Lai, Y., et al., "Evidence for the Failure of Adeno-Associated Virus Serotype 5 to Package a Viral Genome (greater than or equal to) 8.2kb," Molecular Therapy, Jan. 2010, pp. 75-79, vol. 18, No. 1.

Lambert, S. R., et al., "Concordance and Recessive Inheritance of Leber Congenital Amaurosis," American Journal of Medical Genetics, 1993, pp. 275-277, vol. 46, No. 3.

Le Meur, G., et al., "Restoration of Vision in RPE65-deficient Briard Dogs Using an AAV Serotype 4 Vector That Specifically Targets the Retinal Pigmented Epithelium," Gene Therapy, 2007, pp. 292-303, vol. 14, No. 4.

Lemmers, C., et al., "CRB3 Binds Directly to Par6 and Regulates the Morphogenesis of the Tight Functions in Mammalian Epithelial Cells," Molecular Biology of the Cell, Mar. 2004, pp. 1324-1333, vol. 15, No. 3.

Levitt, N., et al., "Definition of An Efficient Synthetic Poly(A) Site," Genes & Development, 1989, pp. 1019-1025, vol. 3, No. 7.

(56) References Cited

OTHER PUBLICATIONS

Li, Q., et al., "Intraocular Route of AAV2 Vector Administration Defines Humoral Immune Response and Therapeutic Potential," Molecular Vision, 2008, pp. 1760-1769, vol. 14.

Li, W., et al., "Gene Therapy Following Subretinal AAV5 Vector Delivery is Not Affected by a Previous Intravitreal AAV5 Vector Administration in The Partner Eye," Molecular Vision, 2009, pp. 267-275, vol. 15.

Li, W., et al., "AAV-6 Mediated Efficient Transduction of Mouse Lower Airways," Virology, Sep. 2011, pp. 327-333, vol. 417, No. 2.

Li, X., et al., "Gene Therapy Rescues Cone Structure and Function in the 3-Month-Old rd12 Mouse: A Model for Midcourse RPE65 Leber Congenital Amaurosis," Investigative Ophthalmology & Visual Science, Jan. 2011, pp. 7-15, vol. 52, No. 1.

Livak, K. J., et al., "Analysis of Relative Gene Expression Data Using Real-Time Quantitative PCR and the 2(-Delta Delta C(T)) Method," Methods, 2001, pp. 402-408, vol. 25, No. 4.

Lotery, A. J., et al., "Mutations in the CRB1 Gene Cause Leber Congenital Amaurosis," Archives of Ophthalmology, Mar. 2001, pp. 415-420, vol. 119, No. 3.

Lotery, A. J., et al., "CRB1 Mutations May Result in Retinitis Pigmentosa Without Para-Arteriolar RPE Preservation," Ophthalmic Genetics, 2001, pp. 163-169, vol. 22, No. 3.

Lotery, A. J., et al., "Adeno-Associated Virus Type 5: Transduction Efficiency and Cell-Type Specificity in the Primate Retina," Human Gene Therapy, Nov. 2003, pp. 1663-1671, vol. 14, No. 17.

Maguire, A. M., et al., "Safety and Efficacy of Gene Transfer of Leber's Congenital Amaurosis," The New England Journal of Medicine, May 2008, pp. 2240-2248, vol. 358, No. 21.

Maguire, A. M., et al., "Age-Dependent Effects of RPE65 Gene Therapy for Leber's Congenital Amaurosis: A Phase 1 Dose-escalation Trial," Lancet, Nov. 2009, pp. 1597-1605, vol. 374, No. 9701.

Mancuso, K., et al., "Gene Therapy for Red-Green Colour Blindness in Adult Primates," Nature, Oct. 2009, pp. 784-787, vol. 461, No. 7265.

McKay, G. J., et al., "Pigmented Paravenous Chorioretinal Atrophy is Associated With a Mutation Within the Crumbs Homolog 1 (CRB1) Gene," Investigative Ophthalmology & Visual Science, Jan. 2005, pp. 322-328, vol. 46, No. 1.

Mehalow, A. K., et al., "CRB1 is Essential for External Limiting Membrane Integrity and Photoreceptor Morphogenesis in the Mammalian Retina," Human Molecular Genetics, 2003, pp. 2179-2189, vol. 12, No. 17.

Moore, A. T., et al., "A Syndrome of Congenital Retinal Dystrophy and Saccade Palsy—a Subset of Leber's Amaurosis," British Journal of Ophthalmology, 1984, pp. 421-431, vol. 68.

Mowat, F. M., et al., "RPE65 Gene Therapy Slows Cone Loss in Rpe65-Deficient Dogs," Gene Therapy, 2013, pp. 545-555, vol. 20.

Mussolino, C., et al., "AAV-Mediated Photoreceptor Transduction of The Pig Cone-enriched Retina," Gene Therapy, 2011, pp. 637-645, vol. 18, No. 7.

Aartsen, W. M., et al., "GFAP-Driven GFP Expression in Activated Mouse Muller Glial Cells Aligning Retinal Blood Vessels Following Intravitreal Injection of AAV2/6 Vectors," PLoS One, Aug. 2010, pp. 1-12, e12387, vol. 5, Issue 8.

Acland, G. M., et al., "Gene Therapy Restores Vision in a Canine Model of Childhood Blindness," Nature Genetics, May 2001, pp. 92-95, vol. 28, No. 1.

Acland, G. M., et al., "Long-Term Restoration of Rod and Cone Vision by Single Dose rAAV-Mediated Gene Transfer to the Retina in a Canine Model of Childhood Blindness," Molecular Therapy, Dec. 2005, pp. 1072-1082, vol. 12, No. 6.

Aleman, T. S., et al., "Human CRB 1-Associated Retinal Degeneration: Comparison with the rd8 Crb1-Mutant Mouse Model," Investigative Ophthalmology & Visual Science, Aug. 2011, pp. 6898-6910, vol. 52, No. 9.

Alexander, J. J., et al . . . , "Restoration of Cone Vision in a Mouse Model of Achromatopsia," Nature Medicine, Jun. 2007, pp. 685-687, vol. 13, No. 6.

Allocca, M., et al., "Novel Adeno-Associated Virus Serotypes Efficiently Transduce Murine Photoreceptors," Journal of Virology, Oct. 2007, pp. 11372-11380, vol. 81, No. 20.

Alves, C. H., et al., "Loss of CRB2 in the Mouse Retina Mimics Human Retinitis Pigmentosa Due to Mutations in the CRB1 Gene," Human Molecular Genetics, 2013, pp. 35-50, vol. 22, No. 1.

Alves, C. H., et al., "Targeted Ablation of Crb2 in Photoreceptor Cells Induces Retinitis Pigmentosa," Human Molecular Genetics, 2014, pp. 3384-3401, vol. 23, No. 13.

Amado, D., et al., "Safety and Efficacy of Subretinal Read ministration of a Viral Vector in Large Animals to Treat Congenital Blindness," Science Translational Medicine, Mar. 2010, pp. 1-12, 21ra16, vol. 2, Issue 21.

Annear, M. J., et al., "Gene Therapy in the Second Eye of RPE65-deficient Dogs Improves Retinal Function," Gene Therapy, Jan. 2011, pp. 53-61, vol. 18, No. 1.

Ashtari, M., et al., "The Human Visual Cortex Responds to Gene Therapy-Mediated Recovery of Retinal Function," The Journal of Clinical Investigation, Jun. 2011, pp. 2160-2168, vol. 121, No. 6.

Bainbridge, J. W. B., et al., "Effect of Gene Therapy on Visual Function in Leber's Congenital Amaurosis," The New England Journal of Medicine, May 2008, pp. 2231-2239, vol. 358, No. 21.

Bainbridge, J. W. B., "Prospects for Gene Therapy of Inherited Retinal Disease," Eye, 2009, pp. 1898-1903, vol. 23, No. 10.

Barker, S. E., et al., "Subretinal Delivery of Adeno-Associated Virus Serotype 2 Results in Minimal Immune Responses That Allow Repeat Vector Administration in Immunocompetent Mice," The Journal of Gene Medicine, 2009, pp. 486-497, vol. 11, No. 6.

Bazellieres, E., et al., "Crumbs Proteins in Epithelial Morphogenesis," Front Bioscience, 2009, pp. 2149-2169, vol. 14.

Beltran, W. A., et al., "rAAV2/5 Gene-Targeting to Rods: Dose-Dependent Efficiency and Complications Associated with Different Promoters," Gene Therapy, Sep. 2010, pp. 1162-1174, vol. 17, No. 9.

Bennett, J., et al., "AAV2 Gene Therapy Readministration in Three Adults with Congenital Blindness," Science Translational Medicine, Feb. 2012, 24 pages, 120ra15, vol. 4, No. 120.

Bennicelli, J., et al., "Reversal of Blindness in Animal Models of Leber Congenital Amaurosis Using Optimized AAV2-mediated Gene Transfer," Molecular Therapy, Mar. 2008, pp. 458-465, vol. 16, No. 3.

Bianchi, S., et al., "High Frequency of Exon 10 Mutations in the NOTCH3 Gene in Italian CADASIL Families: Phenotypic Peculiarities," Journal of Neurology, 2010, pp. 1039-1042, vol. 257, No. 6.

Blits, B., et al., "Adeno-Associated Viral Vector (AAV)-Mediated Gene Transfer in the Red Nucleus of the Adult Rat Brain: Comparative Analysis of the Transduction Properties of Seven AAV Serotypes and Lentiviral Vectors," Journal of Neuroscience Methods, 2010, pp. 257-263, vol. 185, No. 2.

Booij, J. C., et al., "Identification of Mutations in the AIPL1, CRB1, GUCY2D, RPE65, and RPGRIP1 Genes in Patients with Juvenile Retinitis Pigmentosa," Journal of Medical Genetics, Nov. 2005, pp. 1-8, vol. 42, No. 11.

Boutin, S., et al., "Prevalence of Serum IgG and Neutralizing Factors Against Adeno-Assciated Virus (AAV) Types 1, 2, 5, 6, 8, and 9 in the Healthy Population: Implications for Gene Therapy Using AAV Vectors," Human Gene Therapy, Jun. 2010, pp. 704-712, vol. 21, No. 6.

Boye, S. E., et al., "Functional and Behavioral Restoration of Vision by Gene Therapy in the Guanylate Cyclase-1 (GC1) Knockout Mouse," PLoS One, Jun. 2010, pp. 1-13, e11306, vol. 5, Issue 6.

Boye, S. E., et al., "The Human Rhodopsin Kinase Promoter in an AAV5 Vector Confers Rod—and Cone-Specific Expression in the Primate Retina," Human Gene Therapy, Oct. 2012, pp. 1101-1115, vol. 23, No. 10.

Boye, S. E., et al., "A Comprehensive Review of Retinal Gene Therapy," Molecular Therapy, Mar. 2013, pp. 509-519, vol. 21, No. 3.

Boye, S. L., et al., "Long-Term Preservation of Cone Photoreceptors and Restoration of Cone Function by Gene Therapy in the Guanylate Cyclase-1 Knockout (GC1KO) Mouse," Investigative Ophthalmology & Visual Science, Sep. 2011, pp. 7098-7108, vol. 52, No. 10.

(56) References Cited

OTHER PUBLICATIONS

Boye, S. L., et al., "AAV-Mediated Gene Therapy in the Guanylate Cyclase (RetGC1/RetGC2) Double Knockout Mouse Model of Leber Congenital Amaurosis," Human Gene Therapy, Feb. 2013, pp. 189-202, vol. 24, No. 2.

Buch, P. K., et al., "AAV-mediated Gene Therapy for Retinal Disorders: From Mouse to Man," Gene Therapy, 2008, pp. 849-857, vol. 15, No. 11.

Bujakowska, K., et al., "CRB1 Mutations in Inherited Retinal Dystrophies," Human Mutation, Feb. 2012, pp. 306-315, vol. 33, No. 2.

Bulgakova, N. A., et al., "The Crumbs Complex: From Epithelial-Cell Polarity to Retinal Degeneration," Journal of Cell Science, 2009, pp. 2587-2596, vol. 122, No. 15.

Chung, D. C., et al., "Leber Congenital Amaurosis: Clinical Correlations with Genotypes, Gene Therapy Trials Update, and Future Directions," Journal of AAPOS, Dec. 2009, pp. 587-592, vol. 13, No. 6.

Cideciyan, A. V., "Leber Congenital Amaurosis Due to RPE65 Mutations and its Treatment with Gene Therapy," Progress in Retinal and Eye Research, Sep. 2010, pp. 398-427, vol. 29, No. 5.

Cideciyan, A. V., et al., "Human RPE65 Gene Therapy for Leber Congenital Amaurosis: Persistance of Early Visual Improvements and Safety at 1 Year," Human Gene Therapy, Sep. 2009, pp. 999-1004, vol. 20, No. 9.

Cideciyan, A. V., et al., "Human Retinal Gene Therapy for Leber Congenital Amaurosis Shows Advancing Retinal Degeneration Despite Enduring Visual Improvement," Proceedings of the National Academy of Sciences of the United States of America, 2013, Pages E517-E525, vol. 110, No. 6.

Corton, M., et al., "High Frequency of CRB1 Mutations as Cause of Early-Onset Retinal Dystrophies in the Spanish Population," Orphanet Journal of Rare Diseases, 2013, 12 pages, vol. 8, No. 20.

Cremers, F. P. M., et al., "Molecular Genetics of Leber Congenital Amaurosis," Human Molecular Genetics, 2002, pp. 1169-1176, vol. 11, No. 10.

Cremers, F. P. M., et al., "The Expanding Roles of ABCA4 and CRB1 in Inherited Blindness," Novartis Foundation Symposium, 2004, pp. 68-79, vol. 255.

Dalkara, D., et al., "Inner Limiting Membrane Barriers to AAV-mediated Retinal Transduction From the Vitreous," Molecular Therapy, Dec. 2009, pp. 2096-2102, vol. 17, No. 12.

Dalkara, D., et al., "AAV Mediated GDNF Secretion From Retinal Glia Slows Down Retinal Degeneration in A Rat Model of Retinitis Pigmentosa," Molecular Therapy, Sep. 2011, pp. 1602-1608, vol. 19, No. 9.

Davis, J. A., et al., "The N1317H Substitution Associated with Leber Congenital Amaurosis Results in Impaired Interdomain Packing in Human CRB1 Epidermal Growth Factor-like (EGF) Domains," The Journal of Biological Chemistry, Sep. 2007, pp. 28807-28814, vol. 282, No. 39.

Den Hollander, A. I., et al., "Mutations in a Human Homologue of Drosophila crumbs Cause Retinitis Pigmentosa (RP12)," Nature Genetics, Oct. 1999, pp. 217-221, vol. 23.

Den Hollander, A. I., et al., "CRB1 has a Cytoplasmic Domain That is Functionally Conserved Between Human and Drosophila," Human Molecular Genetics, 2001, pp. 2767-2773, vol. 10, No. 22.

Den Hollander, A. I., et al., "Leber Congenital Amaurosis and Retinitis Pigmentosa with Coats-like Exudative Vasculopathy Are Associated With Mutations in the Crumbs Homologue 1 (CRB1) Gene," American Journal of Human Genetics, 2001, pp. 198-203, vol. 69, No. 1.

Den Hollander, A. I., et al., "Isolation of Crb1, A Mouse Homologue of Drosophila crumbs, and Analysis of its Expression Pattern in Eye and Brain," Mechanisms of Development, 2002, pp. 203-207, vol. 110.

Den Hollander, A. I., et al., "CRB1 Mutation Spectrum in Inherited Retinal Dystrophies," Human Mutation, 2004, pp. 355-369, vol. 24.

Den Hollander, A. I., et al., "Identification of Novel Mutations in Patients with Leber Congenital Amaurosis and Juvenile RP by Genome-wide Homozygosity Mapping with SNP Microarrays," Investigative Ophthalmology & Visual Science, Dec. 2007, pp. 5690-5698, vol. 48, No. 12.

Den Hollander, A. I., et al., "Leber Congenital Amaurosis: Genes, Proteins and Disease Mechanisms," Progress in Retinal and Eye Research, 2008, pp. 391-419, vol. 27, No. 4.

Den Hollander, A. I., et al., "Lighting a Candle in the Dark: Advances in Genetics and Gene Therapy of Recessive Retinal Dystrophies," The Journal of Clinical Investigation, Sep. 2010, pp. 3042-3053, vol. 120, No. 9.

Dong, B., et al., "Characterization of Genome Integrity for Oversized Recombinant AAV Vector," Molecular Therapy, Jan. 2010, pp. 87-92, vol. 18, No. 1.

Drack, A. V., et al., "Which Leber Congenital Amaurosis Patients are Eligble for Gene Therapy Trials?" Journal of AAPOS, Oct. 2009, pp. 463-465, vol. 13, No. 5.

Hirsch, M. L., et al., "Little Vector, Big Gene Transduction: Fragmented Genome Reassembly of Adeno-associated Virus," Molecular Therapy, Jan. 2010, pp. 6-8, vol. 18, No. 1.

Life Technologies, User Guide for pcDNA(TM)4/HisMax A, B, and C, accessed from <https://assets.thermofisher.com/TFS-Assets/LSG/manuals/pcdna4hismax_man.pdf>, Nov. 8, 2011, Catalog No. V864-20, 28 pages.

Wu, Z., et al., "Effect of Genome Size on AAV Vector Packaging," Molecular Therapy, Jan. 2010, pp. 80-86, vol. 18, No. 1.

Alves, C. H., et al., "AAV-Mediated Gene Therapy for CRB 1-Hereditary Retinopathies," Gene Therapy, IntechOpen, 2018, Chapter 6, pp. 119-137.

Chen, X., et al., "CRB2 Mutation Causes Autosomal Recessive Retinitis Pigmentosa," Experimental Eye Research, 2019, pp. 164-173, vol. 180.

Dolon, J. F., et al., "Expression and Localization of the Polarity Protein CRB2 in Adult Mouse Brain: A Comparison with the CRB1(sub rd8) Mutant Mouse Model," Scientific Reports, 2018, pp. 1-13, vol. 8, No. 1.

Hochapfel, F., et al., "Distinct Functions of Crumbs Regulating Slit Diaphragms and Endocytosis in Drosophila Nephrocytes," Cellular and Molecular Life Sciences, 2017, pp. 4573-4586, vol. 74, No. 24.

McCarty, D. M., "Self-Complementary Recombinant Adeno-Associated Virus (scAAV) Vectors Promote Efficient Transduction Independently of DNA Synthesis," Gene Therapy, 2001, pp. 1248-1254, vol. 8.

McCarty, D. M., "Self-Complementary AAV Vectors; Advances and Applications," Molecular Therapy, Oct. 2008, pp. 1648-1656, vol. 16, No. 10.

Meuleman, J., et al., "Crumbs Homologue 1 in Polarity and Blindness," Biochemical Society Transactions, 2004, pp. 828-830, vol. 32, Part 5.

Pellissier, L. P., et al., "Gene Therapy into Photoreceptors and Muller Glial Cells Restores Retinal Structure and Function in CRB1 Retinitis Pigmentosa Mouse Models," Human Molecular Genetics, 2015, pp. 3104-3118, vol. 24, No. 11.

Quinn, P. M., et al., "The CRB1 Complex: Following the Trail of Crumbs to a Feasible Gene Therapy Strategy," Frontiers of Neuroscience, Apr. 2017, p. 1-15, vol. 11, Article 175.

Quinn, P. M., et al., "CRB2 in Immature Photoreceptors Determines the Superior-Inferior Symmetry of the Developing Retina to Maintain Retinal Structure and Function," Human Molecular Genetics, 2018, pp. 3137-3153, vol. 27, No. 18.

Quinn, P. M., et al., "Human iPSC-Derived Retinas Recapitulate the Fetal CRB1 CRB2 Complex Formation and Demonstrate that Photoreceptors and Muller Glia are Targets of AAV5," Stem Cell Reports, May 2019, pp. 906-919, vol. 12, No. 5.

Quinn, P. M., et al., "Loss of CRB2 in Muller Glial Cells Modifies A CRB1-Associated Retinitis Pigmentosa Phenotype into a Leber Congenital Amaurosis Phenotype," Human Molecular Genetics, 2019, pp. 105-123, vol. 28, No. 1.

Slavotinek, A., et al., CRB2 Mutations Produce a Phenotype Resembling Congenital Nephrosis, Finnish Type, with Cerebral Ventriculomegaly and Raised Alpha-Fetoprotein, The American Journal of Human Genetics, Jan. 2015, pp. 162-169, vol. 96.

Slavotinek, A. M., "The Family of Crumbs Genes and Human Disease," Molecular Syndromology, 2016, pp. 274-281, vol. 7, No. 5.

(56) References Cited

OTHER PUBLICATIONS

Wu, J., et al., "Self-Complementary Recombinant Adeno-Associated Viral Vectors: Packaging Capacity and the Role at Rep Proteins in Vector Purity," Technical Report, Human Gene Therapy, Feb. 2007, pp. 171-182, vol. 18.
Zou, J., et al., "The Roles of Crb Proteins During Neurulation and Early Retinal Morphogenesis in Zebrafish," ARVO Annual Meeting Abstract, Apr. 2011, 2 pages.
Alves, C. H., et al., "CRB2 Loss in Rod Photoreceptors is Associated with Progressive Loss of Retinal Contrast Sensitivity," International Journal of Molecular Sciences, 2019, 22 pages, Article 4069, vol. 20, No. 17.
Ebarasi, L., et al., "Defects of CRB2 Cause Steroid-Resistant Nephrotic Syndrome," The American Journal of Human Genetics, 2015, pp. 153-161, vol. 96, No. 1.
Khan, K. N., et al., "A Clinical and Molecular Characterisation of CRB1-Associated Maculopathy," European Journal of Human Genetics, 2018, pp. 687-694, vol. 26, No. 5.
Naso, M. F., et al., "Adeno-Associated Virus (AAV) as a Vector for Gene Therapy," BioDrugs, 2017, pp. 317-334, vol. 31, No. 4.
Quinn, P. M. J., et al., "Retinogenesis of the Human Fetal Retina: An Apical Polarity Perspective," Genes, 2019, 40 pages, Document E987, vol. 10, No. 12.
Stieger, K., et a., "AAV-Mediated Gene Therapy for Retinal Disorders in Large Animal Models," ILAR Journal, 2009, pp. 206-224, vol. 50, No. 2.
Tsang, S. H., et al., "Whole Exome Sequencing Identifies CRB1 Defect in an Unusual Maculopathy Phenotype," Ophthalmology, 2014, pp. 1773-1782, vol. 121, No. 9.
Van Soest, S., et al., "Assignment of a Gene for Autosomal Recessive Retinitis Pigmentosa (RP12) to Chromosome 1q31-q32.1 in an Inbred and Genetically Heterogeneous Disease Population," Genomics, Aug. 1994, pp. 499-504, vol. 22, No. 3.
Van Soest, S., et al., "Fine Mapping of the Autosomal Recessive Retinitis Pigmentosa Locus (RP12) on Chromosome 1q; Exclusion of the Phosducin Gene (PDC)," Cytogenetics and Cell Genetics, 1996, pp. 75-79, vol. 73, Nos. 1-2.
Vazquez-Chona, F. R., et al., "Rlbp1 Promoter Drives Robust Muller Glial GFP Expression in Transgenic Mice," Investigative Ophthalmology and Visual Science, Aug. 2009, pp. 3996-4003, vol. 50, No. 8.
Vogel, J. S., et al., "Identification of the RLBP1 Gene Promoter," Investigative Ophthalmology and Visual Science, Aug. 2007, pp. 3872-3877, vol. 48, No. 8.
Waardenburg, P. J , et al., "On Various Recessive Biotypes of Leber's Congenital Amaurosis," Acta Ophthalmologica, 1963, pp. 317-320, vol. 41.
Wagner, R. S., et al., "High Hyperopia in Leber's Congenital Amaurosis," Archives of Ophthalmology, Oct. 1985, pp. 1507-1509, vol. 103, No. 10.

\* cited by examiner

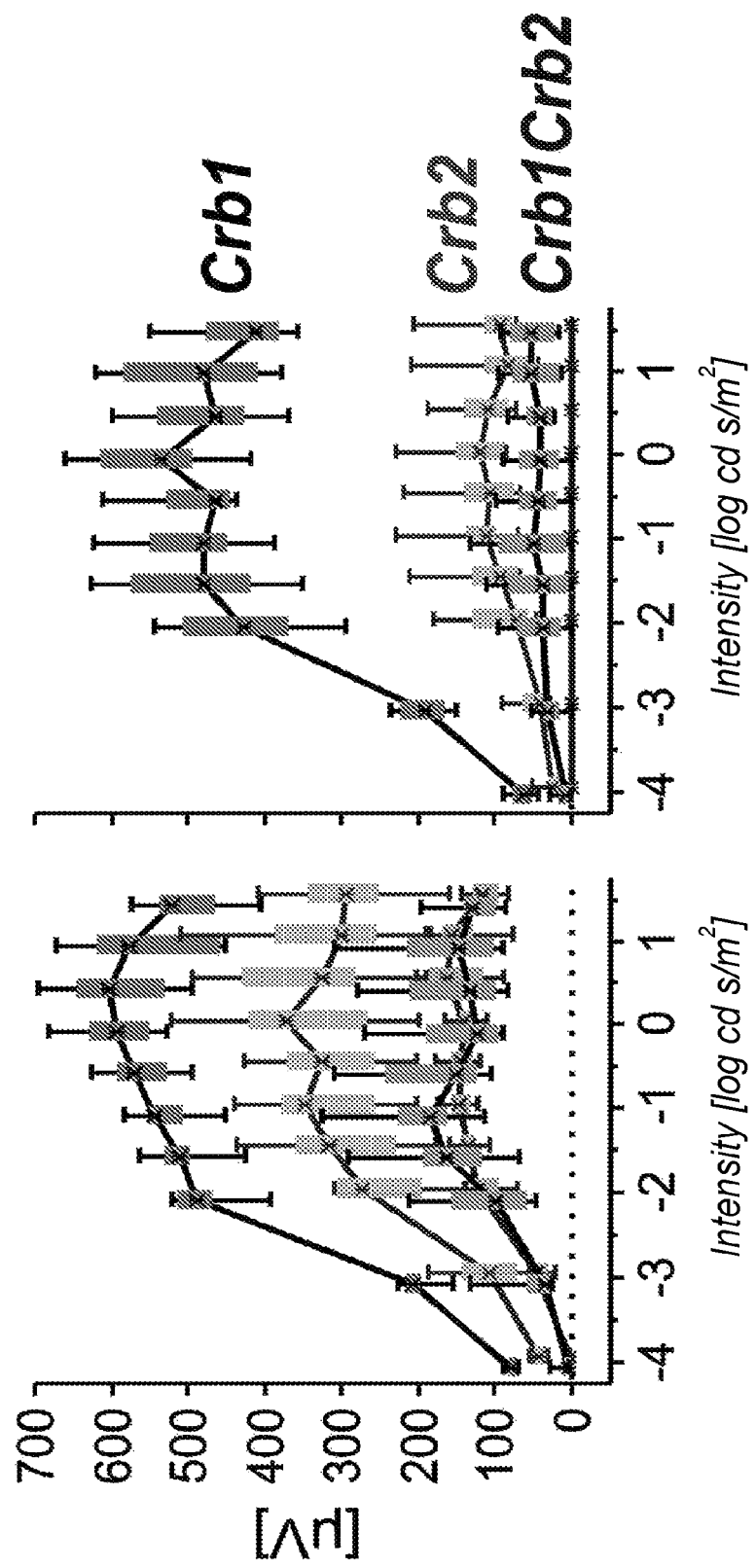

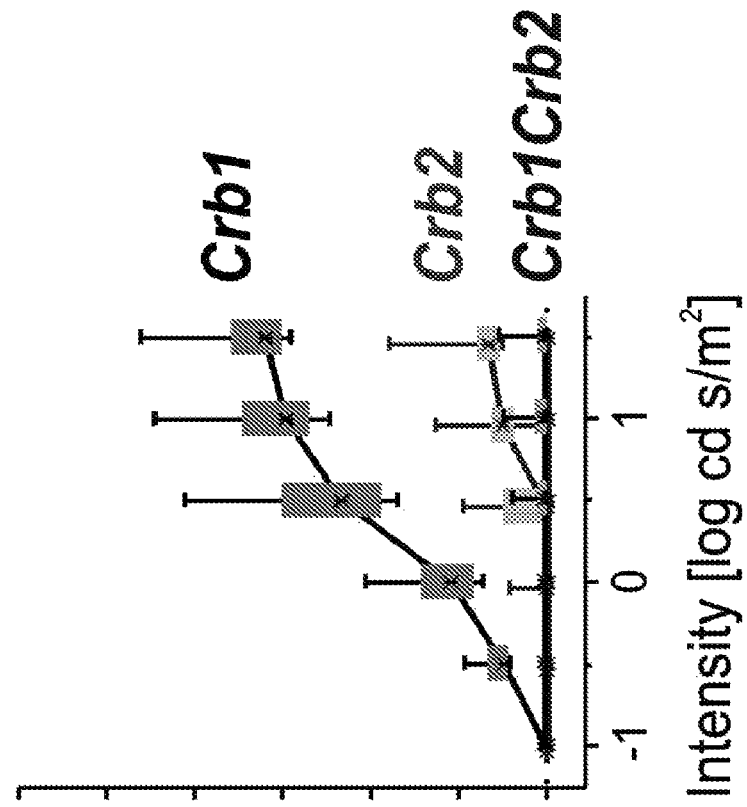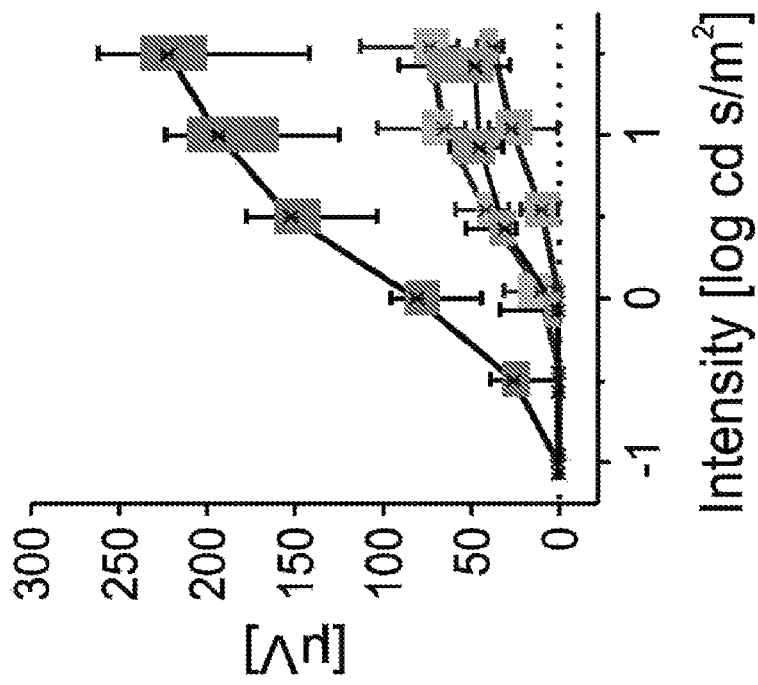
Fig. 7c
Fig. 7d

OLM
OPL

OLM

ILM

RECOMBINANT AAV-CRUMBS HOMOLOGUE COMPOSITION AND METHODS FOR TREATING LCA-8 AND PROGRESSIVE RP

FIELD OF THE INVENTION

This invention relates to the fields of molecular biology, virology and gene therapy. In particular, the invention relates to the treatment of a retinal disorder due to mutations in Crumbs homologue-1 (CRB1) using a gene therapy vector.

BACKGROUND OF THE INVENTION

Leber's congenital amaurosis (LCA) is the earliest and most severe group of inherited retinopathies, with an incidence of two to three in 100.000 people, and is the most common cause of congenital blindness in children. It is an autosomal recessive or dominant condition recognized in infants during the first months of life. LCA type 8 (LCA8) is inherited recessively. Symptoms of LCA8 patients include nystagmus, slow pupil response, retinal dysfunction, impaired vision and ultimately blindness. The eyes of these blind or severely visually impaired infants show an apparent normal fundus but lack of retinal activity as measured by electroretinography (ERG). At least some LCA8 patients show a thicker retina than normal or other LCA patients. LCA8 patients have mutations or DNA alterations in or affecting the CRB1 gene locus. LCA8 patients account for 10-15% of all LCA patients.

Retinitis pigmentosa (RP) is an inherited and severe group of degenerative eye disease that occurs at 1 in 3.000 people and causes severe vision impairment and often results in complete blindness. Severe recessive progressive retinitis pigmentosa occurs in young children that have mutations or DNA alterations in or affecting the Crumbs homologue-1 (CRB1) gene locus. These young children become gradually blind before their twentieth birth day. There is no clear relation between genotype (type of mutation) and phenotype (LCA or RP). RP due to mutations in the CRB1 gene (RP12) account for 3-5% of all RP patients.

Mutations in CRB1 cause recessive retinitis pigmentosa with para-arteriolar preservation of the RPE (PPRPE); recessive retinitis pigmentosa; recessive Leber congenital amaurosis; or dominant pigmented paravenous chorioretinal atrophy. The symptoms may include Coats-like exudative vasculopathy; mutations result in a thickened retina with abnormal lamination. Genetic analyses showed that LCA is mostly monogenic but caused by more than 20 genes, including CRB1 (~10-15% of all cases), CEP290 (~20% of all cases), GUCY2D (~15% of all cases), IMPDH1 (~10% of all cases), RPE65 (~5% of all cases), and the less frequently occurring AIPL1, RPGRIP1, RDH12, NMNAT1, SPATA7, LCA5, CRX, TULP1, MERTK, LRAT, RD3, OTX, CABP4, KCNJ13, IQCB1 and others (den Hollander et al., 2009). Mutations in the CRB1 gene are a leading cause of LCA (10-15% of all cases). Genetic analyses showed that RP is caused by more than 50 genes. Mutations in the CRB1 gene account for 3-5% of all cases of RP (RP12). The number of patients with LCA8 or RP12 due to mutations in CRB1 is about the same as patients with LCA1 due to mutations in the guanylate cyclase 2D (GUCY2D) gene and even twice that of patients with LCA2 due to mutations in the gene coding for retinal pigment epithelium 65 kD protein (RPE65).

It is estimated that more than 100.000 world citizens have type 8 Leber's congenital amaurosis or RP12. The CRB1 gene encodes Crumbs homologue-1 (CRB1) which is expressed in the human retina in photoreceptors and Müller glia cells, as well as in retinal progenitor cells, and localizes adjacent to the adherens junction complex at the outer limiting membrane. CRB1 regulates directly or indirectly the physical interaction between retinal cell types. In the adult human retina, loss of CRB1 results in loss of adhesion between Müller glia cells and photoreceptors resulting in structural changes such as loss of regular lamination. Ultimately, this leads to loss of rod photoreceptors followed by loss of cone photoreceptors by cell death. In the developing retina, loss of CRB1 results in loss of adhesion between retinal progenitor cells and newly differentiated photoreceptors and Müller glia cells. Ultimately, the misplaced cells do not form a functional neuronal network and undergo cell death. Loss of CRB1 in the developing retina also results in an increase in number of late born retinal cells (rod photoreceptors, Müller glia cells, bipolar cells, late born sub-types of amacrine cells) and an increase in mislocalized retinal cells causing an immature appearance of the retina.

Presently there are no therapeutics or effective treatments available to prevent, delay or treat LCA8 or RP12 in humans. Therefore, there is a need in the art for methods and means for the treatment of retinal disorders due to mutations in CRB1. Preferably, the methods and means have no toxicity or almost no toxicity. In particular, the present invention has sought to provide a gene therapy vector to be used for the treatment of retinal disorders due to mutations in CRB1.

SUMMARY OF THE INVENTION

In a first aspect, the present invention relates to a gene therapy vector for use as a medicament, wherein the gene therapy vector comprises: a) a nucleotide sequence encoding a Crumbs homologue-2 (CRB2) protein; and/or b) a nucleotide sequence encoding a modified Crumbs homologue-1 (CRB1) protein or a modified Crumbs homologue-3 (CRB3) protein, wherein the modified CRB1 protein or the modified CRB3 protein comprises a modification in the C-terminal part of the protein. Preferably, the modification in the C-terminal part of the protein of the modified CRB1 or CRB3 proteins reduce the toxicity of the proteins, as can be determined in an in vivo assay. More preferably, the modified CRB1 protein or the modified CRB3 protein is less toxic or not toxic in an in vivo assay. Preferably, such an in vivo assay comprises intravitreal transduction in one eye (e.g. the left eye) of a mouse retina lacking CRB2 or having reduced CRB2 protein levels as compared to a wild-type mouse retina, preferably of a Crb2 conditional knock-out (cKO) or Crb1Crb2$^{F/+}$ cKO mouse, more preferably of a Crb2$^{F/F}$Chx10Cre/+ cKO or Crb1$^{-/-}$Crb2$^{F/+}$Chx10Cre/+ cKO mouse, with AAV particles containing the nucleotide sequence encoding the modified CRB1 or modified CRB3 protein and in the other eye (e.g. the right eye) with a nucleotide sequence encoding a wild-type CRB2 protein, wild-type CRB1 or wild-type CRB3 as a control and determination of the electroretinogram one and three months after transduction, wherein an increased percentage in the maximum a-wave and/or b-wave amplitude (in microvolts) in the electroretinogram in the modified CRB1 or modified CRB3 transduced retinas compared to the electroretinogram in the wild-type CRB1 or wild-type CRB3 transduced retinas indicates that the modified CRB1 protein or the modified CRB3 protein, with amino acid substitutions with substantial identity to the C-terminal part of the CRB2 protein, is less toxic or wherein the maximum a-wave and/or b-wave amplitude (in microvolts) in the electroretinogram is at least 60% of the difference of maximum a-wave and/or b-wave amplitude with wild type CRB2 subtracted with the maximum a-wave and/or b-wave amplitude with modified CRB1 or modified CRB3 protein is not toxic.

In a preferred embodiment, the medicament is for use in treatment or prophylaxis of a retinal disorder due to mutations in the CRB1 gene. More preferably, the retinal disorder is Leber's congenital amaurosis or retinitis pigmentosa, preferably LCA8 or RP12.

In a preferred embodiment, at least one of: a) the CRB2 protein is a eumetazoan CRB2 protein, preferably a CRB2 protein of human, non-human primate, murine, feline, canine, porcine, ovine, bovine, equine, epine, caprine, or lupine origin, more preferably the CRB2 protein is a human CRB2 protein; b) the modified CRB1 protein is a modified eumetazoan CRB1 protein, preferably a modified CRB1 protein of human, non-human primate, murine, feline, canine, porcine, ovine, bovine, equine, epine, caprine, or lupine origin, more preferably the modified CRB1 protein is a modified human CRB1 protein; and c) the modified CRB3 protein is a modified eumetazoan CRB3 protein, preferably a modified CRB3 protein of human, non-human primate, murine, feline, canine, porcine, ovine, bovine, equine, epine, caprine, or lupine origin, more preferably the modified CRB3 protein is a modified human CRB3 protein.

In a preferred embodiment, the gene therapy vector is a recombinant parvoviral vector or a lentiviral vector, more preferably wherein the vector is a recombinant adeno-associated virus (rAAV) vector. More preferably, the gene therapy vector is a recombinant adeno-associated virus vector selected from the group consisting of recombinant adeno-associated virus serotype 1 (rAAV1), recombinant adeno-associated virus serotype 2 (rAAV2), recombinant adeno-associated virus serotype 3 (rAAV3), recombinant adenoassociated virus serotype 4 (rAAV4), recombinant adeno-associated virus serotype 5 (rAAV5), recombinant adeno-associated virus serotype 6 (rAAV6), recombinant adeno-associated virus serotype 7 (rAAV7), recombinant adeno-associated virus serotype 8 (rAAV8), recombinant adeno-associated virus serotype 9 (rAAV), serotype variants, for example for enhanced transduction of Müller glia cells, such as rAAV6 ShH10 and ShH10Y, and combinations thereof.

In a preferred embodiment, the CRB2 protein comprises or consists of an amino acid sequence that has at least 80% sequence identity with the amino acid sequences of any one of SEQ ID NO: 40-63, 65-83, more preferably any one of SEQ ID NO: 40-42 and wherein preferably the CRB2 protein is functionally active as measured by electroretinography.

In a preferred embodiment, the nucleotide sequence encoding CRB2, modified CRB1 or modified CRB3 is operably linked to expression control elements comprising a promoter that produces sufficient expression of CRB2, modified CRB1 or modified CRB3 protein, respectively, to obtain a therapeutic effect, wherein the promoter preferably is selected from the group consisting of: truncated CMV promoter, CMV promoter, truncated human RLBP1 promoter, human photoreceptor specific rhodopsin kinase promoter, and human rod photoreceptor specific rhodopsin promoter, wherein preferably the promoter is selected from the group consisting of: CMV promoter according to SEQ ID NO: 121, truncated human RLBP1 promoter according to SEQ ID NO:122, human photoreceptor specific rhodopsin kinase promoter according to SEQ ID NO:123, human rod photoreceptor specific rhodopsin promoter according to SEQ ID NO:124 and truncated CMV promoter according to SEQ ID NO:133.

In a preferred embodiment, the modification in the C-terminal part of the amino acid sequence of the modified CRB1 or modified CRB3 protein is selected from the group consisting of: i) the PDZ binding domain of CRB1 or CRB3 is replaced by amino acid residues 1282-1285 of SEQ ID NO:40; ii) the FERM binding domain of CRB1 or CRB3 is replaced by amino acid residues 1251-1264 of SEQ ID NO:40; iii) the transmembrane domain of CRB1 or CRB3 is replaced by amino acid residues 1225-1247 of SEQ ID NO:40; iv) the 16 C-terminal amino acid residues of CRB1 or CRB3 are replaced by amino acid residues 1270-1285 of SEQ ID NO:40 or by conserved amino acid substitutions of amino acid residues 1270-1285 of SEQ ID NO:40; v) an amino acid sequence of CRB1 or CRB3 consisting of the FERM binding domain of CRB1 or CRB3, two N-terminal amino acid residues and five C-terminal amino acid residues is replaced by amino acid residues 1249-1269 of SEQ ID NO:40 or by conserved amino acid substitutions of amino acid residues 1249-1269 of SEQ ID NO:40; vi) an amino acid sequence of CRB1 or CRB3 consisting of the transmembrane domain of CRB1 or CRB3, two N-terminal amino acid residues and one C-terminal amino acid residue is replaced by amino acid residues 1223-1248 of SEQ ID NO:40 or by conserved amino acid substitutions of amino acid residues 1223-1248 of SEQ ID NO:40; vii) an amino acid sequence of CRB1 or CRB3 comprising any of a serine, threonine or tyrosine at a position that corresponds to position 1243, 1254, 1257, 1258, 1259, 1261 and/or 1274 of SEQ ID NO:40, wherein preferably the amino acid residues at positions 1243, 1254, 1259, 1261 and 1274 are serine and the amino acid residues at positions 1257 and 1258 are threonine and tyrosine, respectively; and, viii) a combination of one or more i)-vii).

In a second aspect, the present invention relates to a nucleic acid construct comprising at least one of: a) a nucleotide sequence encoding a Crumbs homologue-2 (CRB2) protein and at least one parvoviral inverted terminal repeat (ITR) sequence, wherein preferably the nucleotide sequence encoding a Crumbs homologue-2 (CRB2) protein is operably linked to expression control elements comprising a promoter that is capable of sufficient CRB2 protein expression to obtain a therapeutic effect; and b) a nucleotide sequence encoding a Crumbs homologue-1 (modified CRB1) protein or a Crumbs homologue-3 (modified CRB3) protein, and at least one ITR sequence, wherein preferably the nucleotide sequence encoding a modified CRB1 protein or a modified CRB3 protein is operably linked to expression control elements comprising a promoter that is capable of sufficient modified CRB1 or modified CRB3 protein expression to obtain a therapeutic effect and wherein the modified CRB1 protein or the modified CRB3 protein comprises a modification in the C-terminal part of the protein and is less toxic or not toxic in an in vivo assay, which assay comprises:

intravitreal transduction in one eye of a mouse lacking CRB2 or of a mouse having reduced CRB2, preferably of a Crb2 conditional knock-out (cKO) or Crb1Crb2$^{F/+}$ cKO mouse, more preferably of a Crb2$^{F/F}$Chx10Cre/+ cKO or Crb1$^{-/-}$Crb2$^{F/+}$Chx10Cre/+ cKO mouse, with recombinant adeno-associated virus (rAAV) comprising the nucleotide sequence encoding the modified CRB1 or modified CRB3 protein;

intravitreal transduction in the other eye of the mouse with rAAV comprising a nucleotide sequence encoding a wild-type CRB2 protein, wild-type CRB1 or wild-type CRB3 as a control;

making an electroretinogram one and three months after transduction; and wherein an increased percentage in the maximum a-wave and/or b-wave amplitude in the electroretinogram in the modified CRB1 or modified CRB3 transduced retinas compared to the electroretinogram in the wild-type CRB1 or wild-type CRB3 transduced retinas indicates that the modified CRB1 protein or the modified CRB3 protein is less toxic; or wherein a maximum a-wave and/or b-wave amplitude in the electroretinogram of at least 60% of the difference of maximum a-wave and/or b-wave amplitude with wild type CRB2 subtracted with the maximum a-wave and/or b-wave amplitude with modified CRB1 or modified CRB3 protein indicates that the modified CRB1 protein or the modified CRB3 protein is not toxic.

In a preferred embodiment, the modification in the C-terminal part of the amino acid sequence of the modified CRB1 or modified CRB3 protein is selected from the group consisting of: i) the PDZ binding domain of CRB1 or CRB3 is replaced by amino acid residues 1282-1285 of SEQ ID NO:40; ii) the FERM binding domain of CRB1 or CRB3 is replaced by amino acid residues 1251-1264 of SEQ ID NO:40; iii) the transmembrane domain of CRB1 or CRB3 is replaced by amino acid residues 1225-1247 of SEQ ID NO:40; iv) the 16 C-terminal amino acid residues of CRB1 or CRB3 are replaced by amino acid residues 1270-1285 of SEQ ID NO:40 or by conserved amino acid substitutions of amino acid residues 1270-1285 of SEQ ID NO:40; v) an amino acid sequence of CRB1 or CRB3 consisting of the FERM binding domain of CRB1 or CRB3, two N-terminal amino acid residues and five C-terminal amino acid residues is replaced by amino acid residues 1249-1269 of SEQ ID NO:40 or by conserved amino acid substitutions of amino acid residues 1249-1269 of SEQ ID NO:40; vi) an amino acid sequence of CRB1 or CRB3 consisting of the transmembrane domain of CRB1 or CRB3, two N-terminal amino acid residues and one C-terminal amino acid residue is replaced by amino acid residues 1223-1248 of SEQ ID NO:40 or by conserved amino acid substitutions of amino acid residues 1223-1248 of SEQ ID NO:40; vii) an amino acid sequence of CRB1 or CRB3 comprising any of a serine, threonine or tyrosine at a position that corresponds to position 1243, 1254, 1257, 1258, 1259, 1261 and/or 1274 of SEQ ID NO:40, wherein preferably the amino acid residues at positions 1243, 1254, 1259, 1261 and 1274 are serine and the amino acid residues at positions 1257 and 1258 are threonine and tyrosine, respectively; and, viii) a combination of one or more of i)-vii).

In a third aspect, the present invention relates to a nucleic acid construct according to the invention, wherein preferably, the virion is an AAV virion.

In a fourth aspect, the present invention relates to a host cell comprising the nucleic acid construct according to the invention.

In a fifth aspect, the present invention relates to a pharmaceutical composition comprising a gene therapy vector according to the invention, a nucleic acid construct according to the invention, or a virion according to the invention and a pharmaceutically acceptable excipient.

In a sixth aspect, the present invention relates to a kit comprising: (a) a gene therapy vector in accordance with the invention, a nucleic acid construct according to the invention, a virion according to the invention, or a pharmaceutical composition according to claim the invention; and, (b) optionally, instructions for using the gene therapy vector or pharmaceutical composition according to (a) in the prevention, treatment, or amelioration of one or more symptoms of a retinal disorder due to mutations in CRB1 gene.

DESCRIPTION OF THE INVENTION

Definitions

An "insect cell" as used herein refers to an insect cell which allows for replication of a recombinant parvoviral (rAAV) vector and which can be maintained in culture. For example, the cell line used can be from *Spodoptera frugiperda*, *Drosophila* cell lines, or mosquito cell lines, e.g., *Aedes albopictus* derived cell lines. Preferred insect cells or cell lines are cells from the insect species which are susceptible to baculovirus infection, including e.g. Se301, SeIZD2109, SeUCR1, SD, Sf900+, Sf21, BTI-TN-5B1-4, MG-1, Tn368, HzAm1, Ha2302, Hz2E5, High Five (Invitrogen, CA, USA) and expresSF+® (U.S. Pat. No. 6,103,526; Protein Sciences Corp., CT, USA). Growing conditions for insect cells in culture, and production of heterologous products in insect cells in culture are well-known in the art and described e.g. in the following references on molecular engineering of insects cells. Methodology for molecular engineering and expression of polypeptides in insect cells is described, for example, in Summers and Smith. 1986. A Manual of Methods for Baculovirus Vectors and Insect Culture Procedures, Texas Agricultural Experimental Station Bull. No. 7555, College Station, Tex.; Luckow. 1991. In Prokop et al., Cloning and Expression of Heterologous Genes in Insect Cells with Baculovirus Vectors' Recombinant DNA Technology and Applications, 97-152; King, L. A. and R. D. Possee, 1992, The baculovirus expression system, Chapman and Hall, United Kingdom; O'Reilly, D. R., L. K. Miller, V. A. Luckow, 1992, Baculovirus Expression Vectors: A Laboratory Manual, New York; W. H. Freeman and Richardson, C. D., 1995, Baculovirus Expression Protocols, Methods in Molecular Biology, volume 39; U.S. Pat. No. 4,745,051; US2003148506; and WO 03/074714.

As used herein, the term "operably linked" refers to a linkage of polynucleotide (or polypeptide) elements in a functional relationship. A nucleic acid is "operably linked" when it is placed into a functional relationship with another nucleic acid sequence. For instance, a transcription regulatory sequence is operably linked to a coding sequence if it affects the transcription of the coding sequence. Operably linked means that the DNA sequences being linked are typically contiguous and, where necessary to join two protein encoding regions, contiguous and in reading frame. The phrase "under control of" is used interchangeably herein.

"Expression control sequence" refers to a nucleic acid sequence that regulates the expression of a nucleotide sequence to which it is operably linked. An expression control sequence is "operably linked" to a nucleotide sequence when the expression control sequence controls and regulates the transcription and/or the translation of the nucleotide sequence. Thus, an expression control sequence can include promoters, enhancers, internal ribosome entry sites (IRES), transcription terminators, a start codon in front of a protein-encoding gene, splicing signal for introns, and stop codons. The term "expression control sequence" is intended to include, at a minimum, a sequence whose presence are designed to influence expression, and can also include additional advantageous components. For example, leader sequences and fusion partner sequences are expression control sequences. The term can also include the design of the nucleic acid sequence such that undesirable, potential initiation codons in and out of frame, are removed from the sequence. It can also include the design of the nucleic acid sequence such that undesirable potential splice sites are removed. It includes sequences or polyadenylation sequences (pA) which direct the addition of a polyA tail, i.e., a string of adenine residues at the 3'-end of a mRNA, sequences referred to as polyA sequences. It also can be designed to enhance mRNA stability. Expression control sequences which affect the transcription and translation stability, e.g., promoters, as well as sequences which effect the translation, e.g., Kozak sequences, are known in insect cells. Expression control sequences can be of such nature as to modulate the nucleotide sequence to which it is operably linked such that lower expression levels or higher expression levels are achieved.

As used herein, the term "promoter" or "transcription regulatory sequence" refers to a nucleic acid fragment that functions to control the transcription of one or more coding sequences, and is located upstream with respect to the direction of transcription of the transcription initiation site of the coding sequence, and is structurally identified by the presence of a binding site for DNA-dependent RNA polymerase, transcription initiation sites and any other DNA sequences, including, but not limited to transcription factor binding sites, repressor and activator protein binding sites, and any other sequences of nucleotides known to one of skill in the art to act directly or indirectly to regulate the amount of transcription from the promoter. A "constitutive" promoter is a promoter that is active in most tissues under most physiological and developmental conditions. An "inducible" promoter is a promoter that is physiologically or developmentally regulated, e.g. by the application of a chemical inducer. A "tissue specific" promoter is only active in specific types of tissues or cells.

The terms "substantially identical", "substantial identity", "% identity" or "essentially similar" or "essential similarity" means that two peptide or two nucleotide sequences, when optimally aligned, such as by the programs GAP or BESTFIT using default parameters, share at least a certain percentage of sequence identity as defined elsewhere herein. GAP uses the Needleman and Wunsch global alignment algorithm to align two sequences over their entire length, maximizing the number of matches and minimizes the number of gaps. Generally, the GAP default parameters are used, with a gap creation penalty=50 (nucleotides)/8 (proteins) and gap extension penalty=3 (nucleotides)/2 (proteins). For nucleotides the default scoring matrix used is nwsgapdna and for proteins the default scoring matrix is Blosum62 (Henikoff & Henikoff, 1992, PNAS 89, 915-919). It is clear than when RNA sequences are said to be essentially similar or have a certain degree of sequence identity with DNA sequences, thymine (T) in the DNA sequence is considered equal to uracil (U) in the RNA sequence. Sequence alignments and scores for percentage sequence identity may be determined using computer programs, such as the GCG Wisconsin Package, Version 10.3, available from Accelrys Inc., 9685 Scranton Road, San Diego, Calif. 92121-3752 USA or the open-source software Emboss for Windows (current version 2.7.1-07). Alternatively percent similarity or identity may be determined by searching against databases such as FASTA, BLAST, etc.

As used herein, the term "nucleic acid construct" is intended to mean a nucleic acid molecule (typically comprised of DNA) operably linked to expression control elements, such as for example a promoter that is capable of expression of the nucleic acid molecule.

As used herein, the term "gene therapy vector" is generally intended to mean a nucleic acid molecule (typically comprised of DNA) capable of replication in a host cell and/or to which another nucleic acid segment can be operatively linked so as to bring about replication of the attached segment. A virus is an exemplary gene therapy vector. As used herein, the term "vector" refers to a genetic construct that is composed of genetic material (i.e., nucleic acids). Vectors may include one or more genetic elements as described herein arranged such that an inserted coding sequence can be transcribed and translated in a suitable expression cell. In addition, the vector may include one or more nucleic acid segments, genes, promoters, enhancers, activators, multiple cloning regions, or any combination thereof, including segments that are obtained from or derived from one or more natural and/or artificial sources.

A gene therapy vector disclosed herein may optionally be comprised within an infectious viral particle. The terms "viral particle" and "virion" are used interchangeably herein. Thus, the present invention also encompasses virions as well as host cells that comprise a nucleic acid construct or a gene therapy vector of the invention.

As used herein, the terms "protein", "polypeptide", and "peptide" are used interchangeably, and include molecules that include at least one amide bond linking two or more amino acid residues together. Although used interchangeably, in general, a peptide is a relatively short (e.g., from 2 to about 100 amino acid residues in length) molecule, while a protein or a polypeptide is a relatively longer polymer (e.g., 100 or more residues in length). However, unless specifically defined by a chain length, the terms peptide, polypeptide, and protein are used interchangeably.

As used herein, the term "subject" (also interchangeably referred to as "patient") refers to any subject that can serve as a recipient for a gene therapy vector, a pharmaceutical composition, or a virion of the present invention. In certain aspects, the subject will be a vertebrate animal, which is intended to denote any animal species (and preferably, a mammalian species such as a human being). In certain embodiments, a "patient" refers to any animal host, including but not limited to, human and non-human primates, bovines, canines, caprines, cavines, corvines, epines, equines, felines, hircines, lapines, leporines, lupines, murines, ovines, porcines, racines, vulpines, and the like, including, without limitation, domesticated livestock, herding or migratory animals, exotics or zoological specimens, as well as companion animals, pets, and any animal under the care of a veterinary practitioner.

As used herein, "an effective amount" would be understood by those of ordinary skill in the art to provide a therapeutic, prophylactic, or otherwise beneficial effect to a recipient subject.

The term "isolated" refers to material that is substantially, or essentially, free from components that normally accompany the material as it is found in its native state. Thus, isolated polynucleotides in accordance with the invention preferably do not contain materials normally associated with those polynucleotides in their natural, or in situ, environment.

The phrase "amino acid substitutions in the same functional class" as used herein relates to so-called "conservative" amino acid substitutions, as will be clear to the skilled person. Conservative amino acid substitutions refer to the interchangeability of residues having similar side chains.

For example, a group of amino acids having aliphatic side chains is glycine, alanine, valine, leucine, and isoleucine; a group of amino acids having aliphatic-hydroxyl side chains is serine and threonine; a group of amino acids having small side chains is alanine, serine, threonine, methionine and glycine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; a group of amino acids having acidic side chains is aspartic acid and glutamic acid; and a group of amino acids having sulphur-containing side chains is cysteine and methionine. Preferred conservative amino acids substitution groups are: valine-leucine-isoleucine, phenylalanine-tyrosine, lysine-arginine, alanine-valine, and asparagine-glutamine. Substitutional variants of the amino acid sequence disclosed herein are those in which at least one residue in the disclosed sequences has been removed and a different residue inserted in its place. Preferably, the amino acid change is conservative. Preferred conservative substitutions for each of the naturally occurring amino acids are as follows: Ala to ser; Arg to lys; Asn to gln or his; Asp to glu; Cys to ser or ala; Gln to asn; Glu to asp; Gly to pro; His to asn or gln; Ile to leu or val; Leu to ile or val; Lys to arg, gln or glu; Met to leu or ile; Phe to met, leu or tyr; Ser to thr or gly; Thr to ser or val; Trp to tyr; Tyr to trp or phe; and, Val to ile or leu.

DETAILED DESCRIPTION OF THE INVENTION

The present invention relates to the treatment of a retinal disorder or a disorder associated with cellular changes in the retina, in particular changes due to one or more mutations in CRB1. More specifically, the present invention relates to the treatment of Leber's congenital amaurosis (LCA), in particular Leber's congenital amaurosis-8 (LCA8), and to the treatment of progressive retinitis pigmentosa (RP), in particular progressive retinitis pigmentosa 12 (RP12), or alternatively said early onset RP12. The invention provides a method for at least in part decreasing loss of retinal activity and structural integrity in an animal, wherein the loss of retinal activity and structural integrity comprising at least in part loss of Crumbs homologue (CRB) function in said animal. Preferably, said decreasing of loss of retinal activity and structural integrity is accomplished via a recombinant adeno-associated viral (rAAV) expression vector expressing a first nucleic acid segment encoding a first therapeutic gene product that express a biologically-functional Crumbs homologue (CRB) peptide, polypeptide, or protein for use in one or more investigative, diagnostic and/or therapeutic regimens, including for example, the treatment of one or more disorders or diseases of the mammalian eye, and in particular, for treating congenital retinal blindness including, retinal dystrophy such as Leber's congenital amaurosis type 8 (LCA8) and retinitis pigmentosa (RP) due to lack of sufficient biological Crumbs homologue (CRB) function, in humans. It is preferred that the treatment is not or almost not toxic.

In a first aspect, the present invention relates to a gene therapy vector for use as a medicament, wherein the gene therapy vector comprises: a) a nucleotide sequence encoding a Crumbs homologue-2 (CRB2) protein; and/or b) a nucleotide sequence encoding a modified Crumbs homologue-1 (CRB1) protein or a modified Crumbs homologue-3 (CRB3) protein, wherein the modified CRB1 protein or the modified CRB3 protein comprises a modification in the C-terminal part of the protein. Preferably, the C-terminal part of the modified CRB1 protein or the modified CRB3 protein has substantial identity with the C-terminal part of the CRB2 protein, preferably at least 85, 90, 93, 95, 97, 98 or 99% identity with the C-terminal part of the CRB2 protein, as is further defined below. Preferably, the modification in the C-terminal part of the protein of the modified CRB1 CRB3 proteins reduces the toxicity of the proteins, as can be determined in an in vivo assay. Preferably, the gene therapy vector comprising the sequence encoding for modified CRB1 or modified CRB3 protein is less toxic than the wild-type CRB1 or wild-type CRB3 protein, more preferably the gene therapy vector comprising the sequence encoding for modified CRB1 or modified CRB3 protein is almost not or not toxic in an in vivo assay. Preferably, the assay comprises intravitreal transduction of mouse retinas with reduced levels of or lacking CRB2, preferably mouse retinas lacking CRB1 and having reduced levels of CRB2, in one eye with AAV particles containing the nucleotide sequence encoding the modified CRB1 or modified CRB3 protein and in the other eye with a nucleotide sequence encoding a wild-type CRB2 protein, wild-type CRB1 or wild-type CRB3 as a control and determination of the electroretinogram one and three months after transduction, wherein an increased percentage in the maximum a-wave and/or b-wave amplitude (in microvolts) in the electroretinogram in the modified CRB1 or modified CRB3 transduced retinas compared to the electroretinogram in the wild-type CRB1 or wild-type CRB3 transduced retinas indicates that the modified CRB1 protein or the modified CRB3 protein is less toxic or wherein the maximum a-wave and/or b-wave amplitude (in microvolts) in the electroretinogram is at least 60, 65, 70, 75, 80, 85, 90, 95, 96, 97, 98, 99 or 100% of the difference of maximum a-wave and/or b-wave amplitude with wild type CRB2 subtracted with the maximum a-wave and/or b-wave amplitude with modified CRB1 or modified CRB3 protein is not toxic. Hence, the in vivo assay preferably comprises, or more preferably consists of the steps of:

i) intravitreal transduction in one eye of a mouse (e.g. the left eye) with reduced levels of or lacking CRB2, preferably of a mouse lacking CRB1 and having reduced levels of CRB2, more preferably of a Crb2 conditional knock-out (cKO) or Crb1Crb2$^{F/+}$ cKO mouse, more preferably of a Crb2$^{F/F}$Chx10Cre/+ cKO or Crb1$^{-/-}$Crb2$^{F/+}$Chx10Cre/+ cKO mouse, with 1 μL of 5·10$^9$ genome copies genome copies of recombinant adeno-associated virus (rAAV) comprising the nucleotide sequence encoding the modified CRB1 or modified CRB3 protein, wherein preferably the rAAV is ShH10Y and wherein the nucleotide sequence encoding the modified CRB1 or the modified CRB3 is operably linked to a minimalCMV or a CMV promoter, respectively;

ii) intravitreal transduction in the other eye of the mouse (e.g. the right eye) with 1 μL of 5·10$^9$ genome copies genome copies of rAAV comprising a nucleotide sequence encoding a wild-type CRB2 protein, wild-type CRB1 protein or wild-type CRB3 protein as a control, wherein preferably the rAAV is ShH10Y and wherein the nucleotide sequence encoding the wild-type CRB2, CRB1 or CRB3 protein is operably linked to a CMV, minimalCMV, or a CMV promoter, respectively; and, iii) making an electroretinogram one and three months after transduction, wherein an increased percentage in the maximum a-wave and/or b-wave amplitude in the electroretinogram in the modified CRB1 or modified CRB3 transduced retinas compared to the electroretinogram in the wild-type CRB1 or wild-type CRB3 transduced retinas indicates that the modified CRB1 protein or the modified CRB3 protein is less toxic; or wherein a maximum a-wave and/or b-wave amplitude in the electroretinogram of at least 60, 65, 70, 75, 80, 85, 90, 95, 96, 97, 98, 99 or 100% of the difference of maximum a-wave and/or b-wave amplitude with wild type CRB2 subtracted with the maximum a-wave and/or b-wave amplitude with modified CRB1 or modified CRB3 protein indicates that the modified CRB1 protein or the modified CRB3 protein is not toxic.

In an alternative preferred embodiment, the gene therapy vector comprising the sequence encoding for modified CRB1 or modified CRB3 protein is almost not or not toxic in an in vitro assay. Preferably, the in vitro assay comprises transfection of human-derived retinal pigment epithelial cells with the nucleotide sequence encoding the modified CRB1 or modified CRB3 protein or with a nucleotide sequence encoding CRB1 protein, CRB2 protein or CRB3 protein as a control and determination of cell viability 72 hours after transfection. Preferably the CRB1, CRB2, and CRB3 control proteins are wild-type CRB1, CRB2, and CRB3 proteins. The modified CRB1 protein or the modified CRB3 protein having a higher percentage of viable cells than wild-type CRB1 protein or wild-type CRB3 protein indicates that the modified CRB1 protein or the modified CRB3 protein is less toxic than the wild-type CRB1 protein or the wild-type CRB3 protein. Alternatively, a percentage of viable cells of at least 60, 65, 70, 75, 80, 85, 90, 95, 96, 97, 98, 99 or 100% of the percentage of viable cells of control CRB2 protein indicates that the modified CRB1 protein or the modified CRB3 protein is not toxic.

In more detail, the in vitro assay preferably comprises transfection of human-derived retinal pigment epithelial cells with the nucleotide sequence encoding the modified CRB1 or modified CRB3 protein together with a nucleotide sequence encoding green fluorescent protein as a transfection control. Human-derived retinal pigment epithelial cells transfected with CRB2 were used as a control. Viability of the cells was determined 72 hours after transfection. Preferably, a percentage of viable cells (i.e., % viable cells= [1.00−(Number of dead cells÷Number of total cells)]×100) of at least 60, 65, 70, 75, 80, 85, 90, 95, 96, 97, 98, 99 or 100% of the percentage of viable cells of control CRB2 protein, more preferably a percentage of viable cells equal to or higher than the percentage of viable cells in the control CRB2 indicates that the modified CRB1 protein or the modified CRB3 protein is not toxic. In a preferred embodiment, the modified CRB1 protein or the modified CRB3 protein is considered non-toxic if the amount of viable cells after treatment of the cells with the nucleotide sequence encoding any of these proteins is at least 80, 90 or 95% of the amount of viable cells in the CRB2 treated control cells.

Since cells that are not viable do not express transgene protein, in a preferred embodiment, further to determination of the percentage of viable cells also the amount of modified CRB1 protein or modified CRB3 protein expressed by the cells is determined, such as for example in an ELISA or a Western Blot. In the example a method for Western blot is provided. If the cells treated with the nucleotide sequence encoding the modified CRB1 protein or the modified CRB3 protein show more protein expression than the wild-type CRB1 or wild-type CRB3 control, then the modified CRB1 protein or the modified CRB3 protein is considered less toxic. If the cells treated with the nucleotide sequence encoding the modified CRB1 protein or the modified CRB3 protein show at least 60, 65, 70, 75, 80, 85, 90, 95 or 100% protein expression of the CRB2 protein expression in the CRB2 control cells (preferably normalized to a housekeeping protein, such as for example actin protein levels), then the modified CRB1 protein or the modified CRB3 protein is considered non-toxic.

If the percentage of viable cells after transfection with the nucleotide sequence encoding modified CRB1 protein or modified CRB3 protein is not statistically significant different from or higher than the percentage of viable cells after transfection with a nucleotide sequence encoding CRB2 protein, then the CRB construct is not toxic. Preferably, if the percentage of viable cells after transfection with the nucleotide sequence encoding modified CRB1 protein or modified CRB3 protein is less than 5, 10, 15, 20, 25, 30, 35, 40, 45, 50, 55, 60%, of the percentage of viable cells after transfection with a nucleotide sequence encoding CRB2 protein, then the construct is said to be toxic.

Preferably, the human-derived retinal pigment epithelial cells are ARPE19 cells, preferably obtained from ATCC CRL-2302.

In a preferred embodiment, the gene therapy vector comprises a nucleotide sequence encoding a CRB2 protein.

The full length CRB1 (for example, SEQ ID NO: 1-2) cannot usually be used in adeno-associated virus because of its size, although recently it has been shown that it is possible to express full length CRB1 using AAV9 when using a small promoter, such as a truncated CMV (minimal CMV; preferably SEQ ID NO:133) or hGRK1 promoter (Pellissier et al. (2014) Mol Ther Methods & Clinical Dev 1:14009). The size of normal full length CRB1 cDNA is about 4.22 kb. A vector comprising this sequence and also comprising other expression elements such as a CMV promoter, inverted terminal repeats and 5' untranslated region would approximately be 5.2 kb. Since the normal genome of the preferred vector of this invention, AAV, is 4.7 kb, the recombinant genomes that are larger than 4.9 kb are not packaged correctly in the capsid, thereby often resulting in defective viruses. As a consequence, it was considered that also the shortened version of CRB1 may be useful in gene therapy, since the short variant occurs in several species and with respect to its protein structure resembles CRB2. However, the present inventors found unexpectedly that both the naturally occurring short variant of CRB1 (lacking EGF domains as compared to full-length CRB1; short CRB1 or sCRB1 is shown in SEQ ID NO:3) and also CRB3A (SEQ ID NO:84) were toxic (tested in AAV5 and AAV9 capsid, see Example 1 of the present invention, wherein it is shown that expression of short human CRB1 in immune naïve CRB1 knockout retina is toxic). Therefore, it is preferred that the gene therapy vector of the present invention does not comprise a nucleotide sequence encoding naturally occurring CRB1 and/or CRB3 protein and does not comprise a nucleotide sequence encoding a naturally occurring short variant of CRB1 (lacking EGF domains as compared to full-length CRB1). Examples of these sequences are provided in the sequence listing (e.g. SEQ ID NO: 1-39 and 64 for CRB1 and SEQ ID NO: 84-120 for CRB3). Even more surprisingly, the present inventors found that CRB2 did not result in a significant toxic effect as seen with the naturally occurring short variant of CRB1 and with CRB3.

The inventors' analysis of mice lacking CRB1, mice lacking CRB2, mice lacking CRB1 with reduced levels of CRB2, mice lacking CRB2 with reduced levels of CRB1, and mice lacking both CRB1 and CRB2 suggest very similar functions for CRB1 and CRB2. Similarly, the functions of Crumbs homologue (CRB) proteins are exchangeable e.g. the human CRB1 protein can rescue partially the phenotype in fruit flies lacking Crumbs (Crb) protein (den Hollander et al., 2001), and the zebrafish CRB2B protein can rescue the phenotype in zebrafish lacking CRB2A protein (Omori & Malicki, 2006). Other advantages of endogenously or exogenously increasing levels of human CRB2 protein are the following:

A) human CRB2 cDNA is small, about 3.9 kb, resulting in an expression cassette comprising the CRB2 cDNA and expression elements of typically only about 4.9 kb. It was found that expression of human CRB2 using a parvoviral vector can be obtained in the retina.

B) Native CRB2 is present in the retina of mice both in photoreceptor cells and in Müller glia cells, and possibly also in retinal pigment epithelial cells. Also in other species native CRB2 is present and functional in photoreceptor cells. However, in humans native CRB2 only is present in Müller glia cells, more specifically at the subapical region adjacent to adherens junctions at the outer limiting membrane in Müller glia cells, but not in photoreceptor cells. It is acknowledged that the situation between mice and man differs (FIGS. 1 and 2). Several mouse models have been developed and experiments were performed in several mouse models. In the Examples it has been illustrated that conditional knockout mice have been developed that have a similar phenotype as presented in humans suffering from RP12.

C) The immune system in humans who are deficient in CRB1 may recognize recombinant CRB1 as a non-self protein and possibly an immuno reaction against the recombinant CRB1 is incurred. CRB2 is recognized as a self protein since it is already expressed and immune-tolerated in the retinas and epithelia of other organs of these patients and will not result in an immune response.

The cause of the toxicity of full length and short CRB1 as referred to above is yet unknown and may be on the level of DNA, RNA or protein. Without wishing to be bound by any theory, it is for example possible that overexpression of short CRB1 protein scavenges essential proteins or that the RNA transcript of short CRB1 cDNA results in a disbalance in microRNAs.

In a preferred embodiment, toxicity of CRB proteins is tested using human-derived retinal pigment epithelial cells as indicated in Example 3. Briefly, the assay is performed as follows. The in vitro assay comprises transfection of human-derived retinal pigment epithelial cells with the nucleotide sequence encoding the (modified) CRB1 or (modified) CRB3 protein together with a nucleotide sequence encoding green fluorescent protein as a transfection control. ARPE19 cells (ATCC CRL-2302) are transfected with one of the different CRB constructs (e.g. CRB1, sCRB1, CRB2 isoform 1, CRB2 isoform 2, CRB2 isoform 3, CRB3, or modified versions thereof etc.) together with a control GFP construct (Aartsen et al. (2010) PLoS One 5:e12387; GFAP-driven transgene expression in activated Müller glial cells following intravitreal injection of AAV2/6 vectors; UniProtKB/Swiss-Prot sequence P42212) using the calcium phosphate method (described e.g. in Sambrook and Russell (2001) "Molecular Cloning: A Laboratory Manual ($3^{rd}$ edition), Cold Spring Harbor Laboratory, Cold Spring Harbor Laboratory Press, New York). Cells transfected with a CRB2 construct (preferably having the CRB2 sequence as shown in SEQ ID NO:40), with a wild-type CRB1 construct (preferably having the CRB1 sequence as shown in SEQ ID NO:1 or 2 or in case of wild-type short CRB1 of SEQ ID NO:3) or with a wild-type CRB3 construct (preferably having the CRB3 sequence as shown in SEQ ID NO:84) were used as a control for comparing the percentage of viable cells. Each CRB construct or control is tested in a separate petridish in duplo. The CRB constructs are used in equimolar amounts and a total amount of 20 µg of DNA is added per petridish. CRB constructs are made as described in Example 2.1. Briefly, CRB constructs are made by chemical synthesis and subcloned into pUC57. These constructs comprise AAV2 ITRs (SEQ ID NO:131 and 132), CMV promoter (SEQ ID NO:121), CRB cDNA to be tested (e.g. SEQ ID NO:40 or other CRB sequence, Intron 5 (SEQ ID NO: 128), and synthetic pA (SEQ ID NO:130).

The GFP construct is used as internal transfection control and to provide a fixed amount of DNA of 20 µg to the cells. For example, 18 µg of CRB construct plus 2 µg of GFP construct is used. In this way, a series of equimolar plasmid concentrations can be tested while adding the same amount of DNA, such as for example 2, 4, 8 or 16 µg of CRB construct, plus 18, 16, 12 or 4 µg of GFP construct, respectively.

On the day before transfection, ARPE19 cells are plated in duplicate at 30% of confluence in a 10 cm petridish in DMEM supplemented with 10% Fetal Bovine Serine and penicillin/streptomycin. After refreshing the medium 2 hours before transfection, the transfection mix is prepared with 20 µg of DNA in 500 µl of 0.25M $CaCl_2$ and TE (10 mM Tris, 1 mM EDTA pH 8) buffer per dish. While constantly vortexing, 500 µl of 2×HBS (281 mM NaCl, 100 mM Hepes, 1.5 mM $Na_2HPO_4$, pH 7.12) are added drop wise to the transfection mixture and the complete mix is directly added to the cells for overnight incubation. The medium is refreshed in the following morning (using DMEM supplemented with 10% Fetal Bovine Serine and penicillin/streptomycin). Two days later (i.e. 72 h after transfection), the attached and floating cells are harvested separately (one duplicate) and together (the second duplicate) and after centrifugation, resuspended in 1 mL of Phosphate Buffered Saline (PBS; 137 mM NaCl, 2.7 mM KCl, 10 mM $Na_2HPO_4$ and 1.76 mM $KH_2PO_4$, pH 7.4). Subsequently, cells are tested for viability with a Luna Automated Cell Counter (Logos Biosystems, Inc.; Annandale, USA). The counter determines the number of cells and via Trypan Blue staining discriminates between viable and non-viable cells. Trypan Blue staining was performed using the Standard protocol by Life Technologies as further set out in Example 3. It has been described above how it can be determined using the percentage of viability whether a construct employed in this assay is toxic or not toxic.

Since cells that are not viable do not express transgene protein, CRB protein expression can be determined instead of or in addition to the percentage of viable cells. CRB protein expression can be determined using any protein assay, such as for example Western Blotting as outlined in Example 3 or ELISA. Shortly, proteins from the cell lysates are separated by SDS-page electrophoresis. After transfer to nitrocellulose membrane, the nitrocellulose membrane is immunostained for CRB, GFP and Actin proteins and analyzed by Odyssey Infrared Imaging System (LI-COR; Westburg BV, Leusden, the Netherlands). Actin proteins were used for normalization of the obtained data. It has been described above how it can be determined whether a construct employed in this assay is toxic or not toxic.

In a more preferred embodiment, toxicity of CRB proteins is tested using electroretinography on mouse retinas as indicated in Example 6 and as described for the in vivo test in more detail above.

In a preferred embodiment, the gene therapy vector according to the present invention is for use in treatment or prophylaxis of a retinal disorder due to mutations in the CRB1 gene. Alternatively said, in a preferred embodiment the invention relates to the use of a gene therapy vector according to the present invention for the manufacture of a medicament in the treatment of a retinal disorder due to mutations in CRB1 gene. Preferably such mutations in the CRB1 gene result in loss of CRB1 functional protein, as can be determined using electroretinography (ERG), multi-focal ERG, optical coherence tomography (OCT), microperimetry, visual evoked potention (VEP) test, functional Magnetic Resonance Imaging test, or behaviour maze-test (see for example: Bainbridge et al. (2008) N Engl J Med. May 22; 358(21):2231-9; Annear et al. (2011) Gene Ther. January; 18(1):53-61; Maguire et al. (2008) N Engl J Med. May 22; 358(21):2240-8; Testa et al. (2013) Ophthalmology. June; 120(6):1283-91; Cideciyan et al. (2008) Proc Natl Acad Sci USA. September 30; 105(39):15112-7; Watkins et al. (2012) Brain. May; 135(Pt 5):1566-77). These methods provide a quantifiable way to measure the regression or progression of retinal visual function in the examined eye. Preferably, the retinal disorder is Leber's congenital amaurosis or retinitis pigmentosa, more preferably LCA8 or RP12.

Retinitis pigmentosa (RP) is an autosomal recessive or dominant group of diseases that represent progressive or late severe forms of inherited retinal dystrophies affecting initially rod photoreceptors and subsequently cone photoreceptors. The twelve'th gene, located on the long (q) arm of chromosome 1 between positions 31 and 32.1, implicated in the onset of this genetically and clinically heterogeneous, and therefore assigned to the RP12 gene locus (van Soest et al., 1994), was Crumbs homologue-1 (CRB1) (den Hollander et al., 1999). The RP12 gene caused RP with preserved para-arteriolar retinal pigment epithelium (PPRPE) (Heckenlively et al., 1982). Some genes that cause retinitis pigmentosa also cause Leber congenital amaurosis. The CRB1 gene was also implicated in Leber congenital amaurosis (LCA) type 8 (LCA8) and progressive types of RP without PPRPE (den Hollander et al., 2004). LCA is an autosomal recessive or dominant group of diseases that represent the earliest and most severe form of all inherited retinal dystrophies. The RP12 or LCA8 gene encodes for Crumbs homologue-1 (CRB1) which is expressed predominantly in photoreceptors and Müller glia cells at a subapical region adjacent to adherens junctions at the outer limiting membrane in the retina. CRB1 plays a role in the formation and maintenance of adhesion between photoreceptors and Müller glia cells. Without CRB1 protein adhesion between these cells is weakened leading to loss of normal retinal lamination. Without CRB1 protein the subapical CRB1/PALS1/MUPP1 and CRB1/PALS1/PATJ protein complexes, required for maintaining cellular polarization and maintenance of adhesion between photoreceptors and Müller glia cells, are destabilized. Mutations in the CRB1 gene reduce or abolish the ability of CRB1 protein to maintain the subapical CRB1/PALS1/MUPP1 and CRB1/PALS1/PATJ protein complexes and to maintain the adhesion between photoreceptors and Müller glia cells, as in RP with mutations in the CRB1 gene or LCA8. It is unclear why some people with CRBJ gene mutations have severe, early visual impairment associated with Leber congenital amaurosis, and other people experience more gradual vision loss and other eye problems associated with retinitis pigmentosa. Other genetic factors (such as CRB2; Alves et al., 2013) may modify the effects of CRB1 gene mutations to influence the severity of these conditions.

The first report of LCA was published in 1869 by Theodor Leber. Currently, at least twenty genes have been reported to cause LCA. Mutations in CRB1 account for ~15% of all cases of LCA making it one of the leading causes of LCA. Diagnosis of LCA8 is typically made within the first few months of life in an infant with severely impaired vision or total blindness, a flat electroretinogram (ERG) and involuntary eye movements (nystagmus) (Hufnagel et al., 2013). Loss of normal retinal structure in LCA8 is unlike other forms of the disease which exhibit marked retinal thinning that generally worsens with age (Pasadhika et al., 2009) or exhibit preserved retinal structure with loss of retinal activity as is the case for LCA1 due to mutations in the Gucy2d gene. Using spectral-domain optical coherence tomography (SDOCT) to scan the central macular and perifoveal areas, a study revealed that LCA8 patients typically show a thicker retina with loss of the 6 retinal layers and immature appearance, compared to people without eye-disease or patients with other types of LCA such as LCA2 (Jacobson et al., 2003).

Less severe retinal degeneration is observed in visually-impaired patients lacking a functional CRB1 gene due to retinitis pigmentosa. Retinitis pigmentosa is the leading cause of inherited retinal degeneration-associated blindness. Retinitis pigmentosa (RP) is a disease condition that was first identified and named by Dr. Donders in 1857. Retinitis pigmentosa is a group of related conditions that are inherited, progressive and clinically distinctive and share a similar feature of dystrophy or damage to the photoreceptors of the retina and of the pigment epithelium underneath the photoreceptors. Currently, at least 50 genes have been reported to cause dominant or recessive RP. Around 30-40% are autosomal dominant, 50 to 60% are autosomal recessive and 5 to 15% are X-chromosome linked. The prevalence is 1 in 4,000 among all age groups and 1 in 3,000 persons in population younger than 65 years of age. Mutations in CRB1 account for ~3-5% of all cases of RP making it one of the leading causes of RP. The number of patients affected by recessive mutations in the CRB1 gene (RP and LCA) is approximately double that affected by mutations in the RPE65 gene (LCA type 2 or LCA2) for which successful AAV-mediated gene therapy trials have been described. Diagnosis of RP patients is typically made within the first decades of life with initial vision problems especially in dim light. This manifests as a loss of vision around the peripheries, known as tunnel vision. The central vision is spared until the later stages of the disease. RP12 patients typically show preserved para-arteriole retinal pigment epithelium (PPRPE) (Heckenlively, 1982). The preservation of retinal structure in patients with RP compared to patients with LCA8 due to mutations in the CRB1 gene does suggest that they are better suited for future therapeutic strategies, but timely expression of the CRB1 gene in LCA8 patients will rescue the structure and function of LCA8 retinas as well.

Loss of CRB1 function in humans leads to progressive RP12 or LCA8, though loss of CRB1 function in mice leads to relative mild retinal disorganization and degeneration. It is unclear why some people with CRB1 gene mutations have severe, early visual impairment associated with Leber congenital amaurosis, and other people experience more gradual but progressive early onset vision loss and other eye problems associated with retinitis pigmentosa. It is also unclear why mice lacking CRB1 show a relative mild phenotype compared to humans lacking CRB1. Other genetic factors (such as CRB2; Alves et al., 2013) may modify the effects of Crb1 gene mutations to influence the severity of these conditions. Indeed, mice lacking CRB2 in the retina show a phenotype mimicking progressive RP detected in human patients lacking CRB1 (Alves et al., 2013), and mice lacking CRB2 and CRB1 mimic LCA8 detected in human patients lacking CRB1 (Pellissier et al., PLoS Genet. 2013 December; 9(12):e1003976). Other factors involved are light exposure; exposure to moderate levels of white light significantly increased the level of retinal disorganization and degeneration in mice lacking CRB1 (van de Pavert et al., 2004; van de Pavert et al., 2007a; van de Pavert et al., 2007b).

In part the phenotypes in mice and humans may differ because of different localization of CRB1 and CRB2 proteins. In the mouse retina, immuno electron microscopy showed that CRB1 localizes in the apical villi of Müller glia cells at the subapical region (SAR) adjacent to adherens junctions (AJ) at the outer limiting membrane (OLM). In the mouse retina, CRB2 localizes at two regions: the inner segments of photoreceptors at the subapical region (SAR) adjacent to adherens junctions (AJs) at the outer limiting membrane (OLM), as well as at the apical villi of Müller glia cells at the subapical region (SAR) adjacent to adherens junctions (AJs) at the outer limiting membrane (OLM) (van Rossum et al., 2006). Loss of CRB1 in the mouse retina therefore leaves functional CRB2 protein in photoreceptors and Müller glia cells, resulting in a mild phenotype.

In the human retina, immuno electron microscopy showed that CRB2 localizes in the apical villi of Müller glia cells at the subapical region (SAR) adjacent to adherens junctions (AJ) at the outer limiting membrane (OLM). In the human retina, CRB1 localizes at two regions: the inner segments of photoreceptors at the subapical region (SAR) adjacent to adherens junctions (AJs) at the outer limiting membrane (OLM), as well as at the apical villi of Müller glia cells at the subapical region (SAR) adjacent to adherens junctions (AJs) at the outer limiting membrane (OLM) (Pellissier et al., Hum Mol Genet. 2014 Jul. 15; 23(14):3759-71). Loss of CRB1 in the human retina therefore leaves functional CRB2 protein at the SAR in Müller glia cells but not in photoreceptors, resulting in a severe phenotype.

Three mouse models carrying mutations in the Crb1 gene have been described. Homozygote mice with the naturally occurring rd8 mutation in the Crb1 gene (Crb1$^{rd8/rd8}$) show mild retinal degeneration, preferentially in one quadrant of the retina, the inferior (ventral) nasal quadrant (Aleman et al., 2011; Mehalow et al., 2003). Homozygote knock-out mice lacking any CRB1 protein (Crb1$^{-/-}$) show mild retinal degeneration, preferentially in one quadrant of the retina, the inferior (ventral) temporal quadrant (van de Pavert et al., 2004; van de Pavert et al., 2007a). Heterozygote knock-in/heterozygote knock-out mice expressing no wild-type mouse CRB1 but expressing CRB1 with a substitution at position 249 of amino-acid tryptophane (W) for a cystein (C) (Crb1$^{C249W/-}$) show very late stage mild retinal degeneration (van de Pavert et al., 2007b). Crb1$^{C249W/-}$ mice were developed as a mouse model for RP12 patients with a C250W substitution in both alleles.

Importantly, in none of the 3 mouse models (Crb1$^{rd8/rd8}$, Crb1$^{-/-}$, or Crb1$^{C249W/-}$) there was a significant decrease in retinal function as measured by electroretinography (Aleman et al., 2011; Mehalow et al., 2003; van de Pavert et al., 2004; van de Pavert et al., 2007a; van de Pavert et al., 2007b). Therefore, these mice appeared not suitable for testing efficacy of CRB gene therapy vectors as measured by electroretinography.

Several other newly developed mouse models are useful for evaluating gene replacement therapy. First, the Crb2 conditional knock-out mouse (Crb2 cKO) lacking CRB2 in all retinal cells except the retinal pigment epithelium (e.g. the Crb2$^{flox/flox}$Chx10Cre) (Alves et al., 2013). Second, the Crb2 conditional knock-out mouse lacking CRB2 in photoreceptors (e.g. the Crb2$^{flox/flox}$CrxCre) (Alves et al., Hum Mol Genet. 2014 Jul. 1; 23(13):3384-401). Third, the Crb2 conditional knock-out mouse lacking CRB2 in Müller glia cells (e.g. Crb2$^{flox/flox}$PdgfraCre) (Alves et al., Hum Mol Genet. 2014 Jul. 1; 23(13):3384-401). Fourth, the homozygote Crb1 heterozygote Crb2 conditional knock-out mouse lacking CRB1 in all retinal cells and having reduced expression of CRB2 in all retinal cells except the retinal pigment epithelium (e.g. Crb1$^{-/-}$Crb2$^{flox/+}$Chx10Cre) (Pellissier et al., Hum Mol Genet. 2014 Jul. 15; 23(14):3759-71). Fifth, the homozygote Crb1 heterozygote Crb2 conditional knock-out mouse lacking CRB1 in all retinal cells and having reduced expression of CRB2 in photoreceptors (e.g. Crb1$^{-/-}$Crb2$^{flox/+}$CrxCre). Sixth, the homozygote Crb1 heterozygote Crb2 conditional knock-out mouse lacking CRB1 in all retinal cells and having reduced expression of CRB2 in Müller glia cells (e.g. Crb1$^{-/-}$Crb2$^{flox/+}$PdgfraCre). Seventh, the homozygote Crb1 homozygote Crb2 conditional knock-out mouse lacking CRB1 in all retinal cells and CRB2 in all retinal cells except the retinal pigment epithelium (e.g. Crb1$^{-/-}$Crb2$^{flox/flox}$Chx10Cre) (Pellissier et al., PLoS Genet. 2013 December; 9(12):e1003976). Eighth, the homozygote Crb1 homozygote Crb2 conditional knock-out mouse lacking CRB1 in all retinal cells and CRB2 in photoreceptors (e.g. Crb1$^{-/-}$Crb2$^{flox/flox}$Crx10Cre). Ninth, the homozygote Crb1 homozygote Crb2 conditional knock-out mouse lacking CRB1 in all retinal cells and CRB2 in Müller glia cells (e.g. Crb1 Crb2$^{flox/flox}$PdgfraCre).

The Crb2 conditional knock-out mouse lacking CRB2 in all retinal cells except the retinal pigment epithelium (e.g. the Crb2$^{flox/flox}$Chx10Cre) (Alves et al., 2013) was used to evaluate gene replacement therapy. The Crb2$^{flox/flox}$Chx10Cre exhibits progressive retinal degeneration and scotopic (rod-mediated) and photopic (cone-mediated) loss of retina function as measured by ERG from 1 to 6 months of age (Alves et al., 2013). The mouse is blind at 12-18 months of age. AAV-mediated transfer of CRB2 to Crb2 cKO retina restored vision to these animals as evidenced by ERG. AAV-mediated transfer of CRB2 to the postnatal Crb2 cKO retina expressed CRB2 in photoreceptors and Müller glia cells and caused preservation of retinal structure at the time of expression of CRB2. These experiments showed the feasibility of preserving retinal structure after a single dose of AAV-CRB2 even in severely degenerating Crb2 cKO retinas.

For testing efficacy of a gene therapy vector of the invention in human patients several standard as well as state of the art techniques are available such as electroretinography, pupillometry, scanning laser ophthalmoscopy, optical coherence tomography, and behavior tests. Especially the use of functional magnetic resonance imaging (fMRI), as biomarker for early improvements in cortical visual function upon treatment of the retina with the AAV-CRB gene therapy vector, will be most useful for analyzing and interpreting different dosing regimes.

In a preferred embodiment, a gene therapy vector of the present invention is used in a combination therapy, for example in combination with a) addition of protective, nurturing or growth factors such as e.g. GDNF or CTNF, b) addition of drugs that normalize the intraocular pressure in eyes such as e.g. eye drops containing prostaglandin analogs, beta blockers, alpha agonists, and/or carbonic anhydrase inhibitors, c) addition of drugs or tools that decrease the light-sensitivity of eyes such as e.g. prosthetic contact lenses, d) addition of drugs that normalize the retinoid cyclus in the retina such as e.g. retinoids, e) addition of drugs that increase the strength of adherens junctions at the retinal outer limiting membrane such as e.g. magnesium and calcium salts.

In a preferred embodiment, the gene therapy vector of the present invention is applied only once to a subject suffering from the retinal disorder due to mutations in CRB1 gene. Re-application of the same or a similar vector, for example with the same or another capsid, is expected to become advantageous with signs of decreased vision in the dark. The same or a similar vector may be re-applied, because injection of the AAV vector subretinally provokes low immune response. In contrast, intravitreal injection has been demonstrated to result in an immune response, but in such cases another suitable vector may be used (Li et al. [2008] Intraocular route of AAV2 vector administration defines humoral immune response and therapeutic potential. Mol Vis. 14:1780-1789). It is envisioned that maze experiments but preferentially fMRI experiments with visual tasks in dimmed light, by testing the visual cortex, will be most instrumental in determining the time point at which a re-application becomes advantageous.

In a preferred embodiment, the subject suffering from the retinal disorder due to mutations in CRB1 gene and to be treated using a gene therapy vector, a nucleic acid construct, a virion, a host cell or a pharmaceutically composition according to the present invention is a mammal, such as e.g. a human, a non-human primate, a mouse, a dog, a cat, a pork, a chicken, a monkey, a cow, a sheep, a rabbit. Most preferably, the subject is a human.

In a preferred gene therapy vector of the present invention: a) the CRB2 protein is a eumetazoan CRB2 protein, preferably a CRB2 protein of human, non-human primate, murine, feline, canine, porcine, ovine, bovine, equine, epine, caprine, or lupine origin, more preferably the CRB2 protein is a human CRB2 protein; b) the modified CRB1 protein is a modified eumetazoan CRB1 protein, preferably a modified CRB1 protein of human, non-human primate, murine, feline, canine, porcine, ovine, bovine, equine, epine, caprine, or lupine origin, more preferably the modified CRB1 protein is a modified human CRB1 protein; and/or c) the modified CRB3 protein is a modified eumetazoan CRB3 protein, preferably a modified CRB3 protein of human, non-human primate, murine, feline, canine, porcine, ovine, bovine, equine, epine, caprine, or lupine origin, more preferably the modified CRB3 protein is a modified human CRB3 protein.

In a preferred embodiment of the present invention, the gene therapy vector is a recombinant parvoviral vector or a lentiviral vector.

Viruses of the Parvoviridae family are small DNA animal viruses. The family Parvoviridae may be divided between two subfamilies: the Parvovirinae, which infect vertebrates, and the Densovirinae, which infect insects. Members of the subfamily Parvovirinae are herein referred to as the parvoviruses and include the genus *Dependovirus*. As may be deduced from the name of their genus, members of the *Dependovirus* are unique in that they usually require coinfection with a helper virus such as adenovirus or herpes virus for productive infection in cell culture.

The genus *Dependovirus* includes adeno-associated virus (AAV), which normally infects humans (e.g., serotypes 1, 2, 3A, 3B, 4, 5, and 6) or primates (e.g., serotypes 1 and 4), and related viruses that infect other warm-blooded animals (e.g., bovine, canine, equine, and ovine adeno-associated viruses). Today, it is possible to differentiate between the serologically distinguishable types of at least AAV-1, AAV-2, AAV-3, AAV-4, AAV-5, AAV-6, AAV-7, AAV-8 and AAV-9. AAV vectors constitute a single-stranded DNA with an outer icosahedral coat of structural protein having a diameter of 18 to 26 nm, typically about 25 nm. Further information on parvoviruses and other members of the Parvoviridae is described in Kenneth I. Berns, "Parvoviridae: The Viruses and Their Replication," Chapter 69 in Fields Virology (3d Ed. 1996). For convenience the present invention is further exemplified and described herein by reference to AAV. It is however understood that the invention is not limited to AAV but may equally be applied to other parvoviruses. It is also understood that the invention extends to AAV chimeric viruses, comprising chimeric capsid proteins and/or AAV hybrid viruses (or pseudotyped viruses) that also have a similar size as found for the wild-type parvoviruses (18-26 nm diameter). A description and some examples are given in WO0028004. Examples of AAV chimeric and/or hybrid viruses are for example AAV2/1, AAV2/3, AAV2/4, AAV2/5, AAV2/5.2, AAV2/6, AAV2/7, AAV2/8 and AAV2/9.

The AAV genome consists of rep genes encoding proteins required for replication of the virus and cap genes encoding the viral structural proteins. One or more of the rep genes which are required for replication (e.g. rep 40, rep 52, rep 68 and/or rep 78) or the cap genes which are required for the capsid structure (e.g. VP-1, VP-2 and/or VP-3) can, for example, be replaced in the virus with a transgene when preparing adeno-associated vectors. The ITR regions which are still present at the 5' and 3' ends are needed, as cis-active elements, for packaging the transgene into infectious, recombinant AAV particles and for the replication of the DNA of the recombinant AAV genome (Kotin, R. M. (1994) Hum Gene Ther. 5(7):793-801). A "recombinant parvoviral or AAV vector" (or "rAAV vector") herein refers to a vector comprising one or more polynucleotide sequences of interest, genes of interest or "transgenes" that are flanked by parvoviral or AAV inverted terminal repeat sequences (ITRs). Such rAAV vectors can be replicated and packaged into infectious viral particles when present in an insect or mammalian host cell that is expressing AAV rep and cap gene products (i.e., AAV Rep and Cap proteins). When an rAAV vector is incorporated into a larger nucleic acid construct (e.g. in a chromosome or in another vector such as a plasmid or baculovirus used for cloning or transfection), then the rAAV vector is typically referred to as a "pro-vector" which can be "rescued" by replication and encapsidation in the presence of AAV packaging functions and necessary helper functions. Thus, in a preferred embodiment, the gene therapy vector of the present invention is a rAAV vector. Even more preferably, the rAAV is selected from the group consisting of recombinant adeno-associated virus serotype 1 (rAAV1), recombinant adeno-associated virus serotype 2 (rAAV2), recombinant adeno-associated virus serotype 3 (rAAV3), recombinant adenoassociated virus serotype 4 (rAAV4), recombinant adeno-associated virus serotype 5 (rAAV5), recombinant adeno-associated virus serotype 6 (rAAV6), recombinant adeno-associated virus serotype 7 (rAAV7), recombinant adeno-associated virus serotype 8 (rAAV8), recombinant adeno-associated virus serotype 9 (rAAV), serotype variants, for example for enhanced transduction of Müller glia cells, such as rAAV6 ShH10 (Klimczak et al PLoS One 4, e7467) and ShH1 OY (Dalkara et al [2011] Mol Ther 19, 1602-1608), and combinations thereof.

In a preferred embodiment, the nucleotide sequence encodes for a CRB2 protein comprising an amino acid sequence that has at least 80%, 85%, 90%, 91%, 92%, 93%, 94%, 95%, 96%, 97%, 98%, 99% preferably at least 100% sequence identity with the amino acid sequences of any one of SEQ ID NO: 40-63, 65-83, more preferably any one of SEQ ID NO: 40-42, most preferably SEQ ID NO:40. Such a CRB2 protein preferably has an intracellular domain of 37 amino acid residues or alternatively an intracellular domain plus transmembrane domain of 63 amino acid residues. Without wishing to be bound by any theory, these domains in particular are considered most relevant for membrane localization and formation of the Crumbs homologue (CRB) protein complex linked to the actin cytoskeleton of the cell, which are believed to be important to rescue the phenotype and non-toxicity. More preferably, the nucleotide sequence encodes for a CRB2 protein consisting of an amino acid sequence that has at least 80%, 85%, 90%, 91%, 92%, 93%, 94%, 95%, 96%, 97%, 98%, 99% preferably at least 100% sequence identity with the amino acid sequences of any one of SEQ ID NO: 40-63, 65-83, more preferably any one of SEQ ID NO: 40-42, most preferably SEQ ID NO:40. Even more preferably, the nucleotide sequence encodes for a CRB2 protein comprising or consisting of an amino acid sequence as shown in any one of SEQ ID NO: 40-63, 65-83, more preferably any one of SEQ ID NO: 40-42, most preferably SEQ ID NO:40. In a preferred embodiment, the CRB2 protein comprises a contiguous amino acid sequence that is at least 95% identical to the carboxy (C)-terminal region of 37 contiguous amino acids of a sequence as set forth in SEQ ID NO: 40-63, 65-83, more preferably any one of SEQ ID NO: 40-42, even more preferably SEQ ID NO:40. Preferably, a CRB2 protein comprising or consisting of an amino acid sequence as defined herein is a functional or, alternatively said, active CRB2 protein. To test whether a protein comprising or consisting of an amino acid sequence as defined herein is a functional CRB2 protein, preferably electroretinography is performed.

In short, an AAV vector, preferably AAV2/9 or AAV2/5, wherein the capsid is AAV9 or AAV5 and the ITRs are AAV2, is generated to allow expression of the CRB2 protein comprising or consisting of an amino acid sequence as defined herein operably linked to a CMV promoter. A construct can be made according to the Examples as presented herein. The AAV vector is administered subretinally to the retina of Crb2 cKO mice ($Crb2^{F/F}$-Chx10Cre) on postnatal day 14. The contralateral eye receives a control AAV vector which comprises GFP instead of the CRB2 protein to be tested. A positive control animal receives a recombinant AAV expressing CRB2 protein according to SEQ ID NO: 40, 41 or 42. At 3 months of age or later, i.e. at least 2.5 months after application of the virus, a-wave and b-wave electroretinograms are made as described in Tanimoto et al. (Tanimoto N, Sothilingam V, Seeliger M W; Functional phenotyping of mouse models with ERG. Methods Mol Biol. 2013; 935:69-78). Briefly, retinas of anesthetized mice are exposed to light flashes at different intensities (on the x-axis the light intensity expressed as log ($cd*s/m^2$)). A CRB2 protein comprising or consisting of an amino acid sequence as defined herein is considered to have CRB2 activity (or to be a functional CRB2 protein) if the maximal b-wave and/or a-wave amplitude (in microvolts) in the electroretinogram is increased by at least 1.1, 1.2, 1.3, 1.4, 1.5, 1.6, 1.7, 1.8, 1.9 or 2.0 fold as compared to the AAV-GFP treated contralateral retina. More preferably, the AAV vector is administered not on postnatal day 14, but on postnatal day 3 or 4, since this may significantly increase the efficacy of treatment.

In a preferred embodiment, in the gene therapy vector according to the invention, the nucleotide sequence encoding CRB2, modified CRB1 or modified CRB3 is operably linked to expression control elements comprising a promoter that produces sufficient expression of CRB2, modified CRB1 or modified CRB3 protein, respectively, to obtain a therapeutic effect, wherein the promoter preferably is selected from the group consisting of: CMV promoter, preferably according to SEQ ID NO:121, CMV promoter, truncated CMV or minimal CMV promoter, truncated human RLBP1 promoter, human photoreceptor specific rhodopsin kinase promoter and human rod photoreceptor specific rhodopsin promoter. The nucleic acid sequence of an illustrative human Müller glia specific retinaldehyde binding protein-1 (RLBP1) promoter (Pellissier L P, Hoek R M, Vos R M, Aartsen W M, Klimczak R R, Hoyng S A, Flannery J G, Wijnholds J (2014) Specific tools for targeting and expression of Muller glia cells. Mol Ther Methods & Clinical Dev 1:14009; similar in part to the published mouse RLBP1 promoter described in Vazquez-Chona et al., 2009; Vogel et al., 2007) which is preferred for use in the present invention is shown in SEQ ID NO: 122.

The nucleic acid sequence of an illustrative human GRK1 specific promoter (Khani et al., 2007; Boye et al., 2012) which is preferred for use in the present invention is shown in SEQ ID NO:123.

The nucleic acid sequence of an illustrative human RHO specific promoter (Pellissier L P, Hoek R M, Vos R M, Aartsen W M, Klimczak R R, Hoyng S A, Flannery J G, Wijnholds J (2014) Specific tools for targeting and expression of Muller glia cells. Mol Ther Methods & Clinical Dev 1:14009) which is preferred for use in the present invention is shown in SEQ ID NO:124.

The nucleic acid sequence of an illustrative truncated CMV promoter (Pellissier L P, Hoek R M, Vos R M, Aartsen W M, Klimczak R R, Hoyng S A, Flannery J G, Wijnholds J (2014) Specific tools for targeting and expression of Muller glia cells. Mol Ther Methods & Clinical Dev 1:14009) is shown in SEQ ID NO:133.

Particularly preferred gene therapy constructs of the present invention are the following: AAV-hGRK1-CRB2 (specific for rod and cone photoreceptors); AAV-hRHO-CRB2 (specific for rod but not cone photoreceptors); AAV-CMV-CRB2 (allows expression in rod+cone photoreceptors, Müller glia cells, and retinal pigment epithelium); AAV-CMV-CRB2-miRT (that reduces transcription in retinal pigment epithelium); AAV-truncatedRLBP1-CRB2; AAV-truncatedCMV-CRB2. AAV-hGRK1-CRB2 (specific for rod and cone photoreceptors) and AAV-hRHO-CRB2 (specific for rod but not cone photoreceptors) and AAV-CMV-CRB2 are most preferred.

The nucleic acid sequence of illustrative micro RNA target sites (miRT's) to lower the expression of AAV transcript containing the miRT sequence in retinal pigment epithelium cells (Karali et al., 2011) which can be used in combination with the present invention is shown in SEQ ID NOs: 125-127. These sequences are the predicted and functional target sites in e.g. the AAV-CMV-CRB2-miRT vector, not the miRNA sequences themselves. miRNAs, that recognize and interfere with the translation of, or degrade, the target CRB2-miRT mRNA transcript, are expressed in the RPE. The skilled person is capable of using such miRTs in the present invention (see for example Karali et al. (2011) PLoS One 6(7):e22166. doi: 10.1371/journal.pone.0022166. Epub 2011 Jul. 26).

In a preferred embodiment of the present invention, recombinant CRB protein, preferably CRB2, is expressed in rod and cone photoreceptor cells, but not in retinal pigment epithelium or Müller glia cells. This can be achieved for example by applying the human photoreceptor specific rhodopsin kinase promoter according to SEQ ID NO:123. As a result, the retina is protected against degeneration. A preferred gene therapy vector of the invention is hGRK1-hCRB2(In5)-spA using AAV2 ITR and AAV5 capsid proteins.

In an embodiment of the present invention, the gene therapy vector comprises a nucleotide sequence encoding a modified CRB1 protein. Because of the size of e.g. human CRB1, this nucleotide sequence cannot be placed under control of a CMV promoter, since it would result in a construct that is too large for generation of viable AAV virions. Thus, for generation of AAV virions a promoter and enhancer elements must be used that result in a vector of about 4.9 kb at maximum. In such a case, for example the truncated CMV promoter or human photoreceptor specific rhodopsin kinase promoter can be applied.

In a preferred embodiment, the gene therapy vector according to the invention further comprises operably linked to the nucleotide sequence encoding the CRB protein one or more of the following: inverted terminal repeats such as for example of any wild-type or mutant AAV; a promoter/enhancer such as for example the CMV promoter/enhancer; a wild-type or synthetic transcription splice donor/acceptor site such as for example In5; a wild-type or synthetic transcription poly-adenylation site as for example spA; one or more micro RNA target sites to reduce transcriptional activity in retinal cell types such as for example the retinal pigment epithelium. In a preferred embodiment, the gene therapy vector according to the invention comprises a wild-type, mutant or codon-optimized DNA sequence encoding wild-type or mutant Crumbs homologue (CRB) proteins of any species.

In a preferred embodiment, a wild-type or synthetic transcription splice donor/acceptor site such as for example synthetic intron (In5) has been inserted in the gene therapy vector for stable transcript processing of CRB2, modified CRB1 or modified CRB3. A preferred nucleic acid sequence of an illustrative synthetic intron (In5) in the coding sequence of the Crumbs homologue (CRB) gene is shown in SEQ ID NO: 128. The intron is preferably inserted into CRB2, modified CRB1 or modified CRB3 cDNA between two adjacent exons with a sequence of exon NNNAG/intron/GNNN exon, where G, A, T, C stands for one of the four nucleotides, and N stands for any of the four nucleotides.

In a preferred embodiment, the gene therapy vector according to the invention comprises a nucleotide sequence encoding a CRB2 protein comprising an amino acid sequence that has at least 80%, 85%, 90%, 91%, 92%, 93%, 94%, 95%, 96%, 97%, 98%, 99% preferably at least 100% sequence identity with the amino acid sequence of SEQ ID NO:40 and wherein the promoter is the CMV promoter according to SEQ ID NO:121.

In a particularly preferred embodiment, the gene therapy vector according to the invention comprises a nucleotide sequence encoding a CRB2 protein comprising an amino acid sequence that has at least 80%, 85%, 90%, 91%, 92%, 93%, 94%, 95%, 96%, 97%, 98%, 99% preferably at least 100% sequence identity with the amino acid sequence of SEQ ID NO:40 and wherein the promoter is the human photoreceptor specific rhodopsin kinase promoter according to SEQ ID NO:123. In a preferred embodiment, the mutation in the C-terminal part of the amino acid sequence of the modified CRB1 or modified CRB3 protein is selected from the group consisting of: i) the PDZ binding domain of CRB1 or CRB3 is replaced by amino acid residues 1282-1285 of SEQ ID NO:40; ii) the FERM binding domain of CRB1 or CRB3 is replaced by amino acid residues 1251-1264 of SEQ ID NO:40; iii) the transmembrane domain of CRB1 or CRB3 is replaced by amino acid residues 1225-1247 of SEQ ID NO:40; iv) the 16 C-terminal amino acid residues of CRB1 or CRB3 are replaced by amino acid residues 1270-1285 of SEQ ID NO:40 or by conserved amino acid substitutions of amino acid residues 1270-1285 of SEQ ID NO:40; v) an amino acid sequence of CRB1 or CRB3 consisting of the FERM binding domain of CRB1 or CRB3, two N-terminal amino acid residues and five C-terminal amino acid residues is replaced by amino acid residues 1249-1269 of SEQ ID NO:40 or by conserved amino acid substitutions of amino acid residues 1249-1269 of SEQ ID NO:40; vi) an amino acid sequence of CRB1 or CRB3 consisting of the transmembrane domain of CRB1 or CRB3, two N-terminal amino acid residues and one C-terminal amino acid residue is replaced by amino acid residues 1223-1248 of SEQ ID NO:40 or by conserved amino acid substitutions of amino acid residues 1223-1248 of SEQ ID NO:40; vii) an amino acid sequence of CRB1 or CRB3 comprising any of a serine, threonine or tyrosine at a position that corresponds to position 1243, 1254, 1257, 1258, 1259, 1261 and/or 1274 of SEQ ID NO:40, wherein preferably the amino acid residues at positions 1243, 1254, 1259, 1261 and 1274 are serine and the amino acid residues at positions 1257 and 1258 are threonine and tyrosine, respectively; and, viii) or a combination of one or more of i)-vii).

In a preferred embodiment, the C-terminal part of the modified CRB1 or the modified CRB3 protein are the last 70, 60, 40, 35, 30, 25, 20, 15, 10, 5 residues of the protein. Preferably the last 70, 60, 40, 35, 30, 25, 20, 15, 10, 5 residues of the protein that correspond to SEQ ID NO: 1-39, 64 (modified CRB1) or SEQ ID NO: 84-120 (modified CRB3).

The C-terminus of CRB proteins comprises two protein interaction domains: the FERM domain located immediately adjacent to the transmembrane domain and the PDZ domain at the C-terminus. In addition, there are potential phosphorylation sites. The FERM domain of CRB1/CRB2/CRB3 can bind to several proteins such as for example EPB41L5 (=YMO1) and moesin. The PDZ domain of CRB1/CRB2/CRB3 can bind to at least two proteins: MPP5 (=PALS1) and PAR6 family members (such as for example PAR6A, PAR6B, PAR6C, PARED). It is likely that small modifications in the amino acid sequence of the C terminus (last 63 amino acid residues) can result in differences in the dynamics of the CRB protein complex. In addition, some of the binding proteins inhibit the function of CRB, while other binding proteins enhance the function of CRB. Therefore, it is expected that each separate mutation/substitution of an amino acid in the C-terminal part of CRB1 or CRB3 to a CRB2 amino acid residue (or an amino acid residue from the same functional class) has the possibility to reduce the toxicity seen for native CRB1 and CRB3.

The similarity between the indicated Crumbs homologue (CRB) family member sequences from the different species is readily recognized by those with skills in the art of the field.

Crumbs homologue (CRB) consensus regions as illustrated by reference to amino acid positions of consensus sequence SEQ ID NO:77: Amino acid positions: 265-1515, 1555-2068, and 2083-2146. CRB variable regions: Amino acid positions: 1-264, 1516-1554, and 2069-2082. Other notable regions of the Crumbs homologue (CRB) consensus alignment may or may not include:

(1) Epidermal growth factor like domains at amino acid positions 265 to 301, 304 to 341, 346 to 384, 386 to 423, 425 to 461, 462 to 498, 499 to 530, 543 to 579, 580 to 609, 607 to 644, 646 to 683, 685 to 721, 723 to 759, 761 to 798, 800 to 836, 838 to 900, 902 to 938, 940 to 976, 978 to 1019, 1205 to 1241, 1479 to 1515, 1756 to 1792, 1794 to 1830, 1832 to 1868, 1871 to 1912, 1912 to 1948, 1950 to 1987, 1989 to 2027, 2028 to 2068 of the consensus sequence (known to be essential for activity in polarized cells such as photoreceptors and Müller glia cells—see, e.g., Richard et al., 2006; van de Pavert et al., 2007b).

(2) Laminin G-like domain at amino acid positions 1021 to 1203, 1248 to 1478, and 1555 to 1755 of the consensus sequence (known to be essential for cell adhesion, signalling, migration, assembly, and differentiation activity).

(3) A transmembrane domain at amino acid position 2083 to 2109.

(4) A highly conserved 37 amino acid C-terminal region containing a FERM-protein and C-terminal PDZ-protein binding motifs at amino acid position 2110 to 2146 (Richard et al., 2006).

In a second aspect, the present invention relates to a nucleic acid construct, preferably an isolated nucleic acid construct, comprising: a) a nucleotide sequence encoding a Crumbs homologue-2 (CRB2) protein and at least one parvoviral inverted terminal repeat (ITR) sequence, wherein preferably the nucleotide sequence encoding a Crumbs homologue-2 (CRB2) protein is operably linked to expression control elements comprising a promoter that is capable of sufficient CRB2 protein expression to obtain a therapeutic effect; and/or b) a nucleotide sequence encoding a Crumbs homologue-1 (modified CRB1) protein or a Crumbs homologue-3 (modified CRB3) protein, and at least one ITR sequence, wherein preferably the nucleotide sequence encoding a modified CRB1 protein or a modified CRB3 protein is operably linked to expression control elements comprising a promoter that is capable of sufficient modified CRB1 or modified CRB3 protein expression to obtain a therapeutic effect and wherein the modified CRB1 protein or the modified CRB3 protein comprises a mutation in the C-terminal part of the protein. More preferably, this mutation provides substantial identity of modified CRB1 or modified CRB3 protein with the C-terminal part of a CRB2 protein. Preferably, the nucleic acid construct comprising the sequence encoding for modified CRB1 or modified CRB3 protein is not toxic in an in vitro and/or an in vivo assay. Preferably, the in vitro assay comprises transfection of human-derived retinal pigment epithelial cells with the nucleotide sequence encoding the modified CRB1 or modified CRB3 protein as described above. Preferably, the in vivo assay comprises transduction of mouse retinas with the nucleotide sequence encoding the modified CRB1 or modified CRB3 protein as described above.

In a preferred embodiment, the nucleic acid construct comprises a nucleotide sequence encoding a CRB2 protein.

In a preferred embodiment, the mutation in the C-terminal part of the amino acid sequence of the modified CRB1 or modified CRB3 protein provides substantial identity of modified CRB1 or modified CRB3 protein with the C-terminal part of a CRB2 protein, preferably at least 85, 90, 93, 95, 97, 98, 99 or 100% identity with the C-terminal part of a CRB2 protein, more preferably with the following ranges of amino acid residues of SEQ ID NO:40. In a preferred embodiment, the mutation in the C-terminal part of the amino acid sequence of the modified CRB1 or modified CRB3 protein is selected from the group consisting of: i) the PDZ binding domain of CRB1 or CRB3 is replaced by amino acid residues 1282-1285 of SEQ ID NO:40; ii) the FERM binding domain of CRB1 or CRB3 is replaced by amino acid residues 1251-1264 of SEQ ID NO:40; iii) the transmembrane domain of CRB1 or CRB3 is replaced by amino acid residues 1225-1247 of SEQ ID NO:40; iv) the 16 C-terminal amino acid residues of CRB1 or CRB3 are replaced by amino acid residues 1270-1285 of SEQ ID NO:40 or by conserved amino acid substitutions of amino acid residues 1270-1285 of SEQ ID NO:40; v) an amino acid sequence of CRB1 or CRB3 consisting of the FERM binding domain of CRB1 or CRB3, two N-terminal amino acid residues and five C-terminal amino acid residues is replaced by amino acid residues 1249-1269 of SEQ ID NO:40 or by conserved amino acid substitutions of amino acid residues 1249-1269 of SEQ ID NO:40; vi) an amino acid sequence of CRB1 or CRB3 consisting of the transmembrane domain of CRB1 or CRB3, two N-terminal amino acid residues and one C-terminal amino acid residue is replaced by amino acid residues 1223-1248 of SEQ ID NO:40 or by conserved amino acid substitutions of amino acid residues 1223-1248 of SEQ ID NO:40; vii) an amino acid sequence of CRB1 or CRB3 comprising any of a serine, threonine or tyrosine at a position that corresponds to position 1243, 1254, 1257, 1258, 1259, 1261 and/or 1274 of SEQ ID NO:40, wherein preferably the amino acid residues at positions 1243, 1254, 1259, 1261 and 1274 are serine and the amino acid residues at positions 1257 and 1258 are threonine and tyrosine, respectively; and, viii) or a combination of one or more of i)-vii).

In a third aspect, the present invention relates to a virion, comprising a nucleic acid construct according to the present invention, wherein preferably the virion is an AAV virion.

In a fourth aspect, the present invention relates to a host cell comprising a nucleic acid construct according to the invention. Preferably, the host cell is a mammalian or an insect host cell as defined herein above. If the host cell is a mammalian host cell, then preferably a human host cell.

In a fifth aspect, the present invention relates to a pharmaceutical composition comprising a gene therapy vector according to the invention, a nucleic acid construct according to the invention, or a virion according to the invention and a pharmaceutically acceptable excipient. Pharmaceutically acceptable excipients are well-known by the person skilled in the art. Examples of pharmaceutically acceptable excipients are a buffer, a carrier, a vehicle or a diluent. Preferably, the pharmaceutical composition further comprises one or more of the following: a lipid, a liposome, a lipid complex, an ethosome, a niosome, a nanoparticle, a microparticle, a liposphere, a nanocapsule, or any combination thereof. In a preferred embodiment, the pharmaceutical composition is formulated for administration to the human eye. Typically the composition is administered by direct injection into the retina or the surrounding tissue. More specifically, the composition needs to be suitable for sub-retinal or intravitreal injection and thus needs to be a sterile and isotonic fluid, using NaCl or sugars. In this regard, we refer to International applications WO 2012/114090 A1 and WO 2011/133933 A2.

In a sixth aspect, the invention relates to a kit comprising: (a) a gene therapy vector in accordance with the present invention, a nucleic acid construct according to the present invention, a virion according to the present invention, or a pharmaceutical composition according to the present invention; and (b) instructions for using the gene therapy vector or pharmaceutical composition according to (a) in the prevention, treatment, or amelioration of one or more symptoms of a retinal disorder due to mutations in CRB1 gene.

In this document and in its claims, the verb "to comprise" and its conjugations is used in its non-limiting sense to mean that items following the word are included, but items not specifically mentioned are not excluded. In addition, reference to an element by the indefinite article "a" or "an" does not exclude the possibility that more than one of the element is present, unless the context clearly requires that there be one and only one of the elements. The indefinite article "a" or "an" thus usually means "at least one".

All patent and literature references cited in the present specification are hereby incorporated by reference in their entirety.

The following examples are offered for illustrative purposes only, and are not intended to limit the scope of the present invention in any way.

TABLE 1

List of SEQ ID NO's with species, genes and accession numbers

| SEQ ID NO: | Species | gene | UniProtKB/Swiss-Prot Accession Number |
|---|---|---|---|
| 1 | Homo sapiens | CRB1 isoform 1 | P82279-1 |
| 2 | Homo sapiens | CRB1 isoform 2 | P82279-2 |
| 3[1] | Homo sapiens | CRB1 isoform 3 | P82279-3 |
| 4 | Homo sapiens | CRB1 isoform 4 | P82279-4 |
| 5 | Homo sapiens | CRB1 isoform 5 | P82279-5 |
| 6 | Mus musculus | CRB1 isoform 1 | Q8VHS2-1 |
| 7 | Mus musculus | CRB1 isoform 2 | Q8VHS2-2 |
| 8[2] | Mus musculus | CRB1 isoform 3 | Q8VHS2-3 |
| 9 | Mus musculus | CRB1 isoform 4 | Q8VHS2-4 |
| 10 | Rattus norvegicus | CRB1 isoform 1 | D3ZZL8 |
| 11 | Spermophilus tridecemlineatus | CRB1 isoform 1 | I3MCW9 |
| 12 | Pongo abelii [3] | CRB1 isoform 1 | H2N4A7 |
| 13 | Pan troglodytes | CRB1 isoform 1 | H2R3X3 |
| 14[4] | Nomascus leucogenys | CRB1 isoform 1 | G1S8V2 |
| 15 | Gorilla gorilla | CRB1 isoform 1 | G3RZV2 |
| 16 | Gorilla gorilla | CRB1 isoform 2 | G3SK60 |
| 17 | Macaca mulatta | CRB1 isoform 1 | H9FS33 |
| 18[5] | Macaca mulatta | CRB1 isoform 3 | F7DFY1 |
| 19 | Equus caballus | CRB1 isoform 1 | F7CHP4 |
| 20 | Ailuropoda melanoleuca | CRB1 isoform 1 | D2HBN8 |
| 21 | Ailuropoda melanoleuca | CRB1 isoform 2 | G1MGT9 |
| 22 | Bos taurus | CRB1 isoform 1 | F1N3A5 |
| 23 | Cavia porcellus | CRB1 isoform 1 | H0VFY3 |
| 24 | Callithrix jacchus | CRB1 isoform 1 | F7IHH9 |
| 25 | Callithrix jacchus | CRB1 isoform 2 | F6ULV9 |
| 26 | Callithrix jacchus | CRB1 isoform 3 | F7IHI1 |
| 27 | Gallus gallus | CRB1 isoform 1 | E1BT21 |
| 28 | Taeniopygia guttata | CRB1 isoform 1 | H0Z1J9 |
| 29 | Meleagris gallopavo | CRB1 isoform 1 | G1N252 |
| 30 | Danio rerio | CRB1 | Q1A5L3 |
| 31[6] | Takifugu rubripes | CRB1 | H2RRM4 |
| 32 | Pelodiscus sinensis | CRB1 | K7G2S0 |
| 33 | Monodelphis domestica | CRB1 | F6UYP3 |
| 34 | Canis familiaris | CRB1 | F1Q0H7 |
| 35 | Oryctolagus cuniculus | CRB1 | G1TAK8 |
| 36 | Caenorhabditis elegans | CRB1 | Q19350 |
| 37[7] | Xenopus tropicalis | CRB1 isoform 1 | F6URK2 |
| 38[8] | Xenopus tropicalis | secretory protein CRB1 isoform 2 | Q9IBG4 |
| 39 | Anolis carolinensis | CRB1 | not yet known |
| 40 | Homo sapiens | CRB2 isoform 1 | Q5IJ48-1 |
| 41 | Homo sapiens | CRB2 isoform 2 | Q5IJ48-2 |
| 42 | Homo sapiens | CRB2 isoform 3 | Q5IJ48-3 |

TABLE 1-continued

List of SEQ ID NO's with species, genes and accession numbers

| SEQ ID NO: | Species | gene | UniProtKB/Swiss-Prot Accession Number |
|---|---|---|---|
| 43 | Pan troglodytes | CRB2 isoform 1 | H2R133 |
| 44 | Macaca mulatta | CRB2 isoform 1 | H9F357 |
| 45 | Macaca mulatta | CRB2 isoform 2 | F7H6F4 |
| 46 | Sus scrofa | CRB2 isoform 1 | F1SKU3 |
| 47 | Spermophilus tridecemlineatus | CRB2 isoform 1 | I3NFS4 |
| 48 | Otolemur garnettii | CRB2 isoform 1 | H0XLX5 |
| 49 | Bos taurus | CRB2 isoform 1 | F1N2V0 |
| 50 | Bos taurus | CRB2 isoform 2 | G3MYX7 |
| 51 | Loxodonta africana | CRB2 isoform 1 | G3SL69 |
| 52 | Loxodonta africana | CRB2 isoform 2 | G3U9Y6 |
| 53 | Callithrix jacchus | CRB2 isoform 1 | F7H2F5 |
| 54 | Callithrix jacchus | CRB2 isoform 2 | F7H7L7 |
| 55 | Cavia porcellus | CRB2 isoform 1 | H0VG27 |
| 56 | Gorilla gorilla | CRB2 isoform 1 | G3SAT2 |
| 57 | Gorilla gorilla | CRB2 isoform 2 | G3RKD4 |
| 58 | Mus musculus | CRB2 isoform 1 | Q80YA8 |
| 59 | Rattus norvegicus | CRB2 isoform 1 | D4A3W2 |
| 60 | Ailuropoda melanoleuca | CRB2 isoform 1 | G1LX36 |
| 61 | Myotis lucifugus | CRB2 isoform 1 | G1Q9U3 |
| 62 | Oryctolagus cuniculus | CRB2 isoform 1 | G1SWT6 |
| 63 | Monodelphis domesti | CRB2 isoform 1 | F6UYP3 |
| 64 | Sarcophilus harrisii | CRB1 isoform 1 | G3W2U0 |
| 65 | Sarcophilus harrisii | CRB2 isoform 1 | G3WDZ2 |
| 66 | Sarcophilus harrisii | CRB2 isoform 2 | G3WDZ3 |
| 67 | Otolemur garnettii | CRB2 isoform 1 | H0XLX5 |
| 68 | Danio rerio | CRB2a | Q1A5L2 |
| 69 | Danio rerio | CRB2b | I3VKD7 |
| 70 | Latimeria chalumnae | CRB | H3BHZ4 |
| 71[9] | Takifugu rubripes | CRB2 isoform 1 | H2UG11 |
| 72 | Gallus gallus | CRB2 isoform 1 | F1P3N1 |
| 73 | Gallus gallus | CRB2 isoform 2 | E1BYW1 |
| 74 | Taeniopygia guttata | CRB2 isoform 1 | H0Z9G5 |
| 75 | Pelodiscus sinensis | CRB2 isoform 1 | K7FFW6 |
| 76[10] | Xenopus tropicalis | CRB2 isoform 1 | F6QPR5 |
| 77 | Drosophila melanogaster | CRB | P10040 |
| 78 | Daphnia pulex | CRB | E9GB00 |
| 79 | Acyrthosiphon pisum | CRB | J9JPN0 |
| 80 | Acromyrmex echinatior | CRB | F4WXJ1 |
| 81 | Branchiostoma floridae | CRB2 isoform 1 | C3Y2J2 |
| 82 | Strongylocentrotus purpuratus | CRB2 isoform 1 | H3J1J1 |
| 83 | Anolis carolinensis | CRB2 | not yet known |
| 84 | Homo sapiens | CRB3 isoform A | Q9BUF7-1 |
| 85 | Mus musculus | CRB3 isoform A | Q8QZT4-1 |
| 86 | Callithrix jacchus | CRB3 isoform A | F7I870 |
| 87 | Macaca mulatta | CRB3 isoform A | F6WKB4 |
| 88 | Ailuropoda melanoleuca | CRB3 isoform A | G1LKJ7 |
| 89 | Sus scrofa | CRB3 isoform A | F1SBS8 |
| 90 | Sus scrofa | CRB2 isoform 3 | F1SKU4 |
| 91 | Otolemur garnettii | CRB3 isoform A | H0WXN3 |
| 92 | Myotis lucifugus | CRB3 isoform A | G1PSN7 |
| 93 | Loxodonta africana | CRB3 isoform A | G3TBW3-1 |
| 94 | Spermophilus tridecemlineatus | CRB3 isoform A | I3M0B8 |
| 95 | Homo sapiens | CRB3 isoform B | Q9BUF7-2 |
| 96 | Equus caballus | CRB3 isoform A isoform 1 | F6RUX8 |
| 97 | Equus caballus | CRB3 isoform A isoform 2 | F6Z0G7 |
| 98 | Rattus norvegicus | CRB3 isoform A | Q4V8I0 |
| 99 | Cavia porcellus | CRB3 isoform A | H0VZN0 |
| 100 | Sarcophilus harrisii | CRB3 isoform A | G3WE86 |
| 101 | Cricetulus griseus | CRB3 isoform A | G3HCL1 |
| 102 | Danio rerio | CRB3 isoform A isoform 1 | Q1A5L0 |
| 103 | Danio rerio | CRB3 isoform A isoform 2 | Q1A5K9 |
| 104 | Gasterosteus aculeatus | CRB3 isoform A | G3P8A8 |
| 105[11] | Xenopus tropicalis | CRB3 isoform A | Q5EGD4 |
| 106 | Tetraodon nigroviridis | CRB3 isoform A | Q4SE18 |
| 107 | Strongylocentrotus purpuratus | CRB3 isoform A | H3I971 |

TABLE 1-continued

List of SEQ ID NO's with species, genes and accession numbers

| SEQ ID NO: | Species | gene | UniProtKB/ Swiss-Prot Accession Number |
|---|---|---|---|
| 108 | *Mus musculus* | CRB3 isoform B | Q8QZT4-2 |
| 109 | *Callithrix jacchus* | CRB3 isoform B | F6Z7P9 |
| 110 | *Macaca fascicularis* | CRB3 isoform B | G8F358 |
| 111 | *Macaca mulatta* | CRB3 isoform B | F6WKC2 |
| 112 | *Ailuropoda melanoleuca* | CRB3 isoform B | D2HY77 |
| 113 | *Pan troglodytes* | CRB3 isoform B | H2QF51 |
| 114[12] | *Nomascus leucogenys* | CRB3 isoform B | G1S1D6 |
| 115 | *Gorilla gorilla* | CRB3 isoform B | G3QVX7 |
| 116[13] | *Pongo abelii* | CRB3 isoform B | H2NX84 |
| 117 | *Heterocephalus glaber* | CRB3 isoform B | G5C4F3 |
| 118 | *Brugia malayi* | CRB3 | A8PUD4 |
| 119 | *Caenorhabditis elegans* | CRB3 | A0FLQ5 |
| 120 | *Caenorhabditis remanei* | CRB3 | E3MAT4 |

[1] Also known as: short CRB1, sCRB1, CRB1dE3/4, CRB1Δ3/4, CRB1ΔE3/4 (Kantardzhieva et al., 2005)
[2] Also known as: Crb1s
[3] *Pongo pygmaeus abelii*
[4] *Hylobates leucogenys*
[5] Also known as: short CRB1 or sCRB1 or CRB1dE3/4 or CRB1Δ3/4 or CRB1ΔE3/4
[6] *Fugu rubripes*
[7] *Xenopus* sp.
[8] *Xenopus* sp.
[9] *Fugu rubripes*
[10] *Xenopus* sp.
[11] *Xenopus* sp.
[12] *Hylobatus leucogenys*
[13] *Pongo pygmaeus abelii*

TABLE 2

List of SEQ ID NO's and their description

| SEQ ID NO: | Description |
|---|---|
| 121 | CMV promoter flanked at the 5' end with a BglII restriction site (AGATCT) |
| 122 | Human RLBP1 promoter |
| 123 | Human GRK1 specific promoter |
| 124 | Human RHO specific promoter |
| 125 | miR-31-5p target sites |
| 126 | miR-126-3p target sites |
| 127 | miR-211/miR-204 target sites |
| 128 | illustrative synthetic intron (In5) in coding sequence of the CRB gene |
| 129 | illustrative synthetic polyadenylation region flanked at the 3' end with a BglII restriction site (AGATCT) |
| 130 | Illustrative 5' untranslated region |
| 131 | AAV2 inverted terminal repeat flanked at the 3' end with a BglII restriction site (AGATCT) |
| 132 | AAV2 inverted terminal repeat flanked at the 5' end with a BglII restriction site (AGATCT) |
| 133 | Truncated CMV promoter or minimal CMV promoter |

DESCRIPTION OF THE FIGURES

FIG. 7. Loss of retinal activity in Crb1Crb2 cKO compared to Crb1 and Crb2 cKO retinas. Panels a and c, measured ERGs at 3 months of age. Panels b and d, measured ERGs at 1 months of age. Panels a and b, scotopic. Panels c and d, photopic. (Note, at 3 months of age, the very good separation of confidence intervals in b-wave amplitude between Crb1 KO and Crb2 cKO retinas.) The lines in the figures represent the following: the upper most line concerns Crb1 KO, second from the top is Crb2 KO, third from the top is Crb1$^{+/-}$Crb2$^{F/F}$Chx10Cre (heterozygote Crb1$^{+/-}$ homozygote foxed Crb2$^{F/F}$ heterozygote Chx10Cre), the bottom line is Crb1$^{-/-}$Crb2$^{F/F}$Chx10Cre (homozygote Crb1$^{-/-}$ homozygote floxed Crb2$^{F/F}$ heterozygote Chx10Cre).

EXAMPLES

Description of the Mouse Models $Crb1^{-/+}Crb2^{F/F}Chx10Cre/+$ and $Crb1^{-/-}Crb2^{F/F}$ $Chx10Cre/+$ Mice Retinas of $Crb1^{-/+}Crb2^{F/F}Chx10Cre/+$ mice (heterozygote for Crb1, homozygote for floxed Crb2) show to some extent a similar but more severe phenotype than observed in $Crb2^{F/F}Chx10Cre/+$ retinas. Electroretinography showed a significant loss of retinal activity at 1 month of age that progressed quickly. The phenotype starts already at E15.5 (at this time point similar to E17.5 in $Crb2^{F/F}Chx10Cre/+$ retinas), with disruptions at the outer limiting membrane, and rosettes of retinal cells can be detected. A major difference of these mouse retinas compared to the $Crb2^{F/F}$ $Chx10Cre/+$ retinas is the aberrant localization of several retinal cell types. E.g., some amacrine cells ectopically localize in the photoreceptor layer, and some cone and rod photoreceptors ectopically localize at the ganglion cell layer. Nevertheless, in these retinas there is still three nuclear layers (outer and inner, and ganglion) and two plexiform layers (outer and inner) suggesting that the lamination of the retina is grossly normal.

Figure 6:
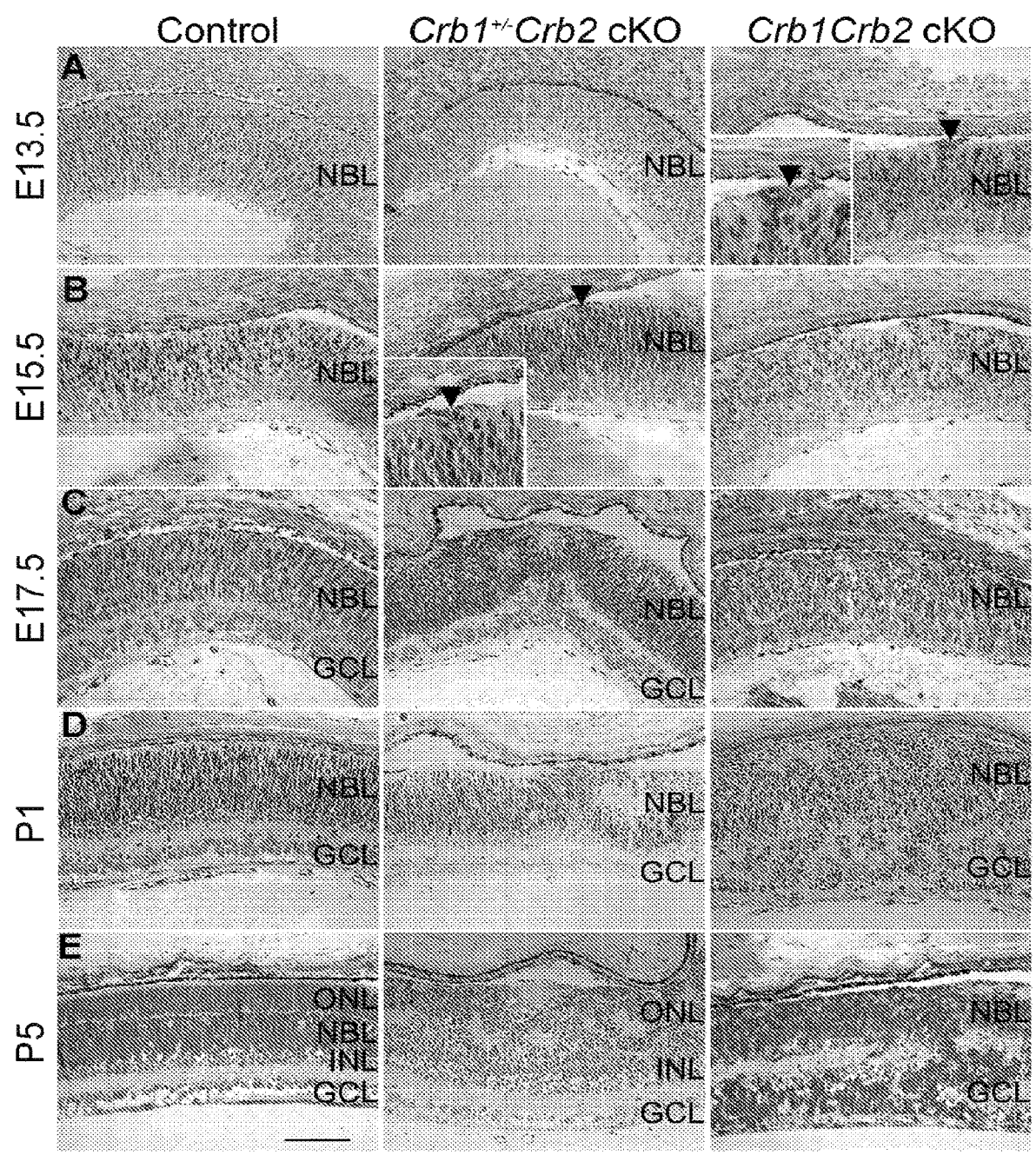
FIG. 6. Loss of a separate photoreceptor layer in Crb1$^{-/-}$Crb2$^{F/F}$Chx10Cre/+ retinas. A-E, Technovit sections. Left panels, control retina. Middle panels, Crb1$^{+/-}$Crb2$^{F/F}$ Chx10Cre/+ retinas. Right panels, Crb1$^{-/-}$Crb2$^{F/F}$ Chx10Cre/+ retinas showing absence of a separate photoreceptor layer and mislocalized retinal cells.
Figure 8:
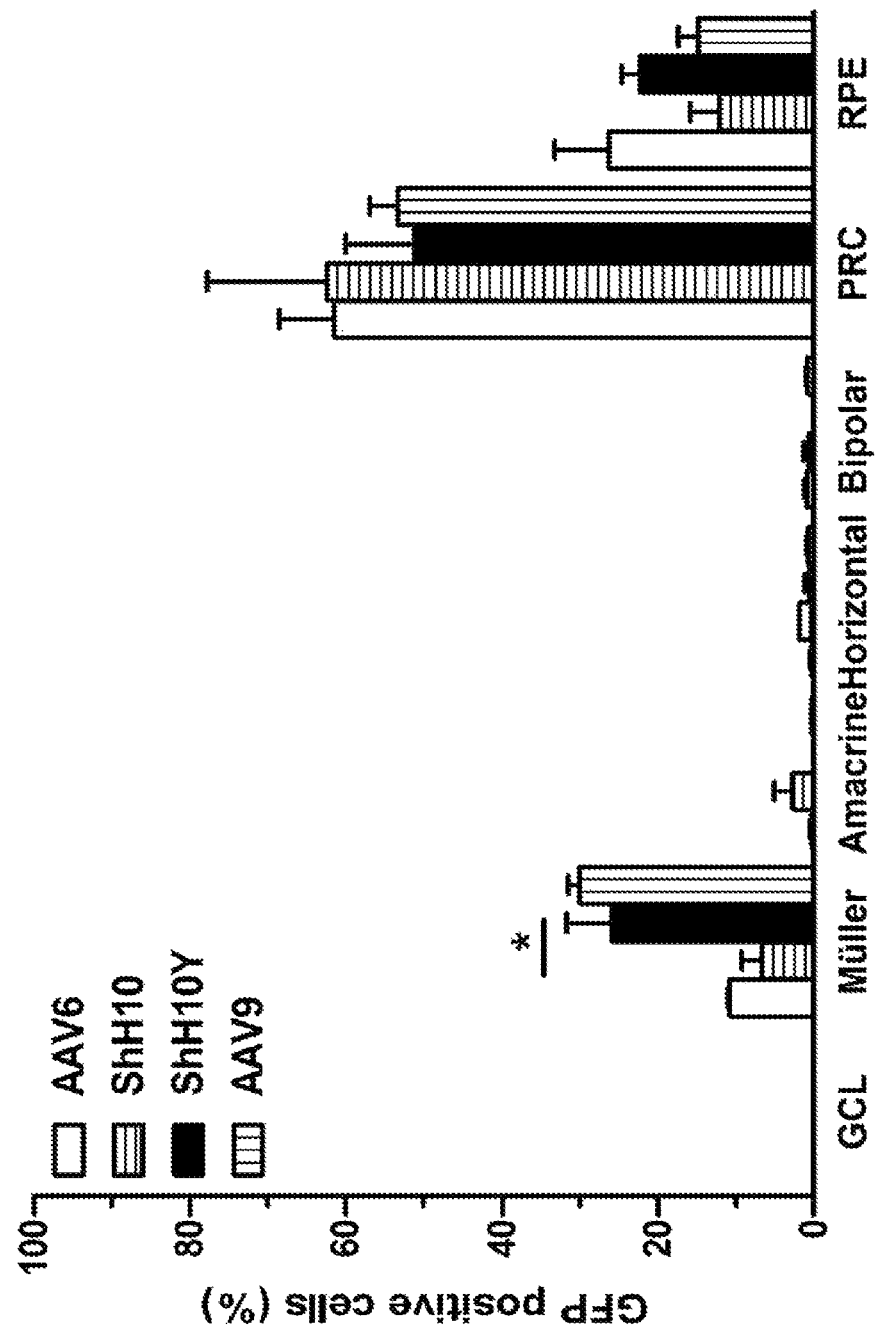
FIG. 8. Upon subretinal injection, AAV9-CMV-GFP and ShH10Y-CMV-GFP infect Müller glia cells and photoreceptors. Abbreviations: GCL, ganglion cells; PRC, photoreceptor cells; RPE, retinal pigment epithelium cells.
Figure 9A:
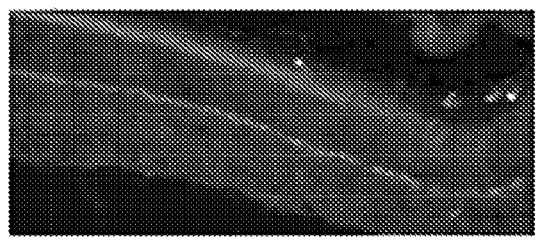
FIG. 9. Expression of short CRB1 (SEQ ID NO. 3) in Crb1 KO retinas using subretinal injection of AAV2/9-CMV-sCRB1 vectors. Panel a, control Crb1 KO retina. Panel b, Crb1 KO retina expressing sCRB1 upon transduction with AAV2/9-CMV-sCRB 1 viral particles. Abbreviations: OLM, outer limiting membrane; OPL, outer plexiform layer. Note: Expression of sCRB1 caused retinal degeneration in about half of the transduced retina (degeneration data not shown).
Figure 9B:
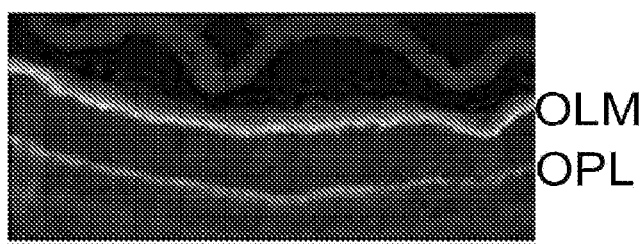

Retinas of $Crb1^{-/-}Crb2^{F/F}Chx10Cre/+$ mice (homozygote for Crb1, homozygote for floxed Crb2; also indicated as Crb1Crb2 cKO) show the most severe phenotype (FIG. 6). Electroretinography showed a severe loss of vision at 1 month of age (though there is still some retinal activity; FIG. 7). These retinas do not show a separate photoreceptor layer (no outer and inner segment, nuclear or outer plexiform layer) and no outer plexiform layer but a single broad nuclear layer, an inner plexiform layer, and a ganglion cell layer. The nuclear layer contains nuclei of rod and cone photoreceptors, bipolar, horizontal, amacrine and Müller glia cells, but surprisingly also nuclei of ganglion cells. The inner plexiform layer only occasionally contains cell nuclei. The ganglion cell layer that normally contains nuclei of ganglion and displaced amacrine cells contains in addition nuclei of rod photoreceptors, bipolar, horizontal, Müller glia cells. So, whereas there is a laminated retina, several early as well as late born cells localized ectopically. Furthermore, there was a significant increase in dividing retinal progenitor cells at E15.5, E17.5, P1 and P5. Concomitant, there is an increase in late born cell types such as rod photoreceptors, bipolar, Müller glia, and late-born amacrine cells, but not in early born cell types such as ganglion, cone photoreceptors, horizontal, and early born amacrine cells. Increased apoptosis was detected at E13.5, E17.5, P1, P5, P14 and at 3 months of age. These data suggest that CRB proteins (CRB2 and CRB1) play a role in suppressing proliferation of late born retinal progenitor cells or timely exiting the cell cycle, in addition to maintaining the adherens junctions between retinal progenitor cells, rod and cone photoreceptors, bipolar and Müller glia cells.

$Crb1^{-/-}Crb2^{F/+}Chx10Cre/+$ Mice

Figure 4:
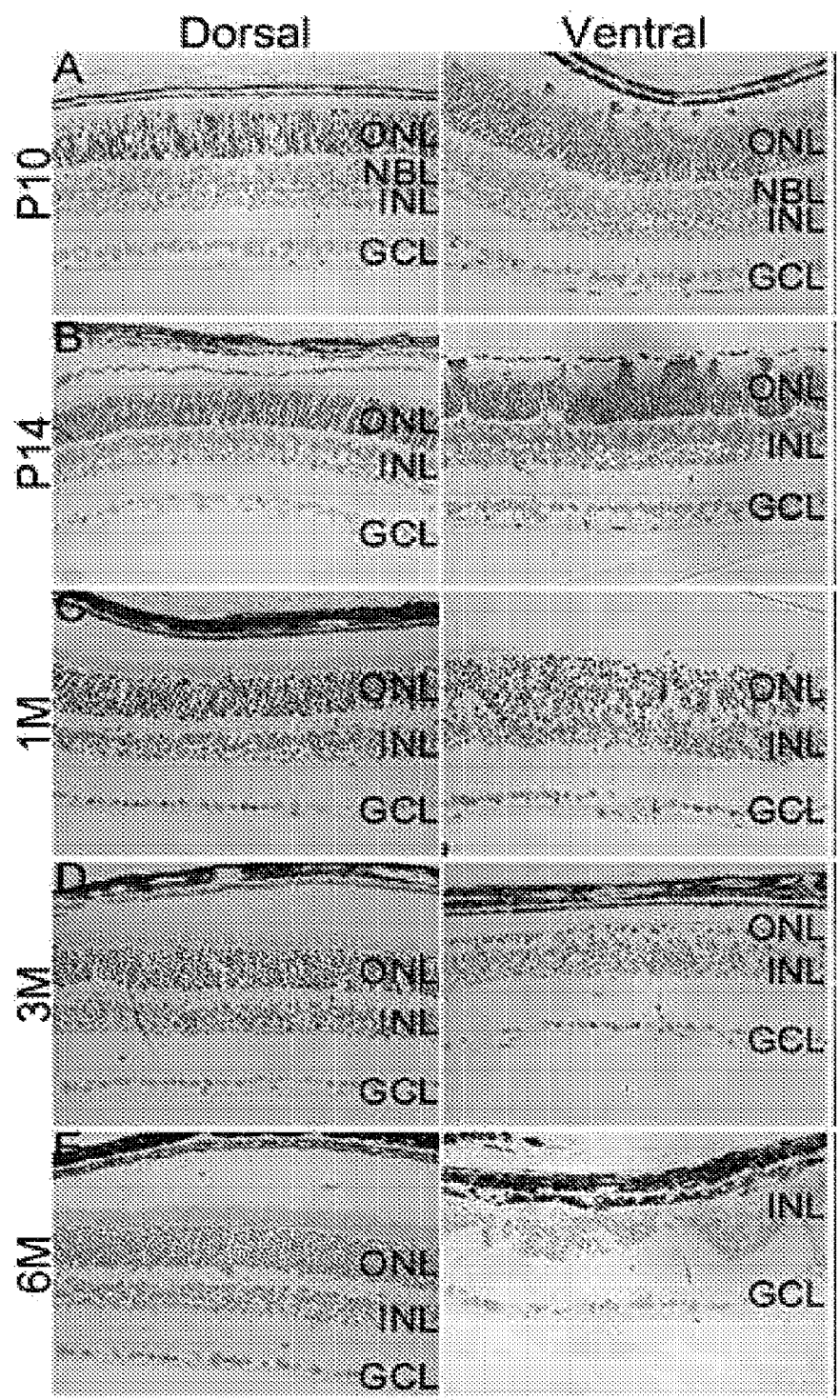
FIG. 4. Degeneration in the ventral but not in the dorsal retina of Crb1$^{-/-}$Crb2$^{F/+}$ Chx10Cre/+ mice. A-E, Technovit sections. Left panels, dorsal (superior) retina. Right panels, ventral (inferior) retina.
Figure 5A:
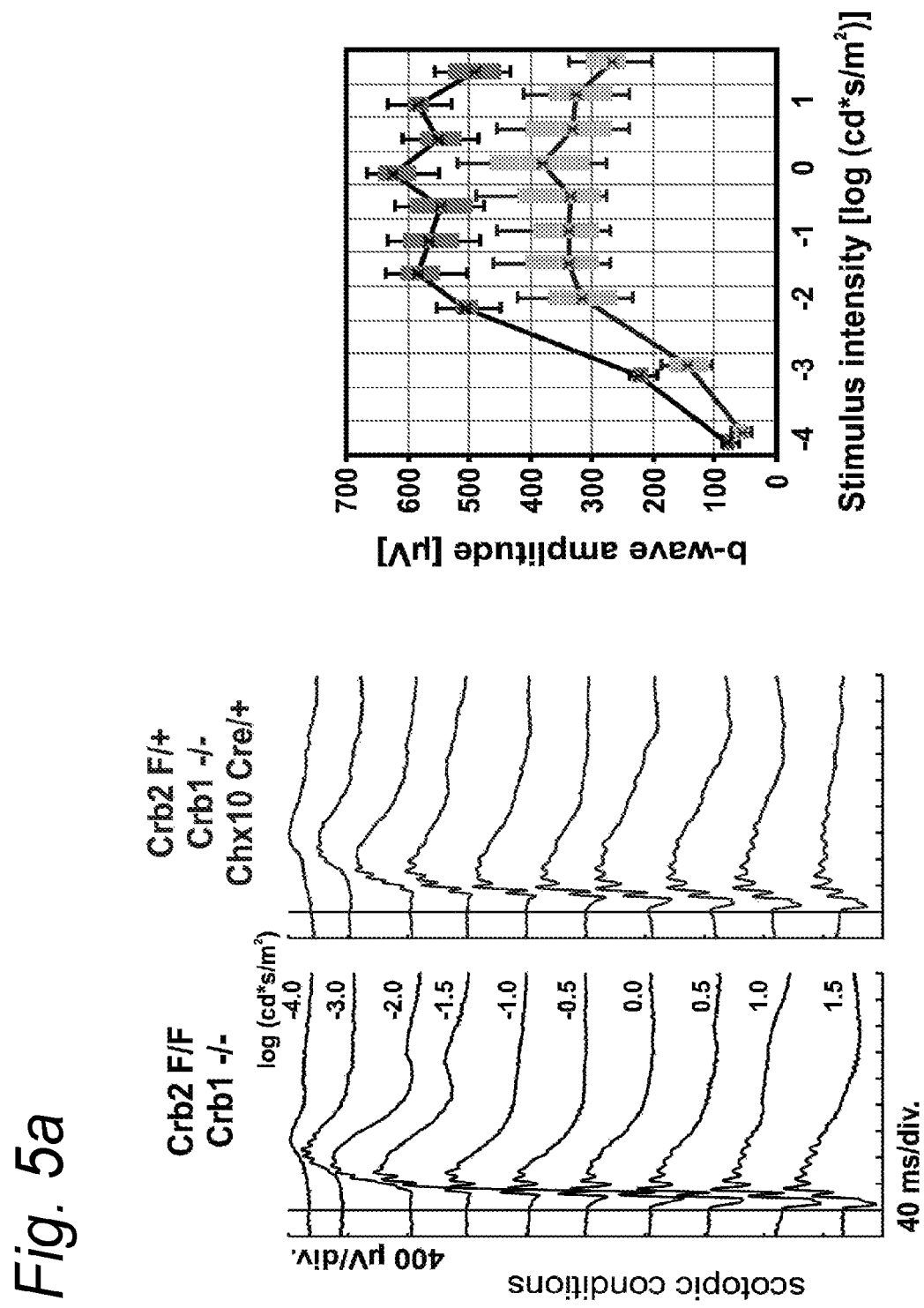
FIG. 5. Electroretinogram b-waves of Crb1$^{-/-}$Crb2$^{F/+}$ Chx10Cre/+ mice (on 50% C57BL/6J and 50% 129/Ola genetic background) showing loss of retinal activity at 3 months of age. Note that wild-type, Crb1$^{-/-}$ and Crb1$^{-/-}$Crb2$^{F/F}$ mice (not containing Chx10Cre) do not show differences in retinal activity (data not shown). Panel a, scotopic ERG showing loss of rod photoreceptor activity in Crb1$^{-/-}$Crb2$^{F/+}$Chx10Cre retinas (light grey; lower line) vs. Crb1$^{-/-}$Crb2$^{F/F}$ retinas (dark grey; upper line). Panel b, photopic ERG showing loss of cone photoreceptor activity in Crb1$^{-/-}$Crb2$^{F/+}$Chx10Cre retinas (light grey; lower line)) vs. Crb1$^{-/-}$Crb2$^{F/F}$ retinas (dark grey; upper line).
Figure 5B:
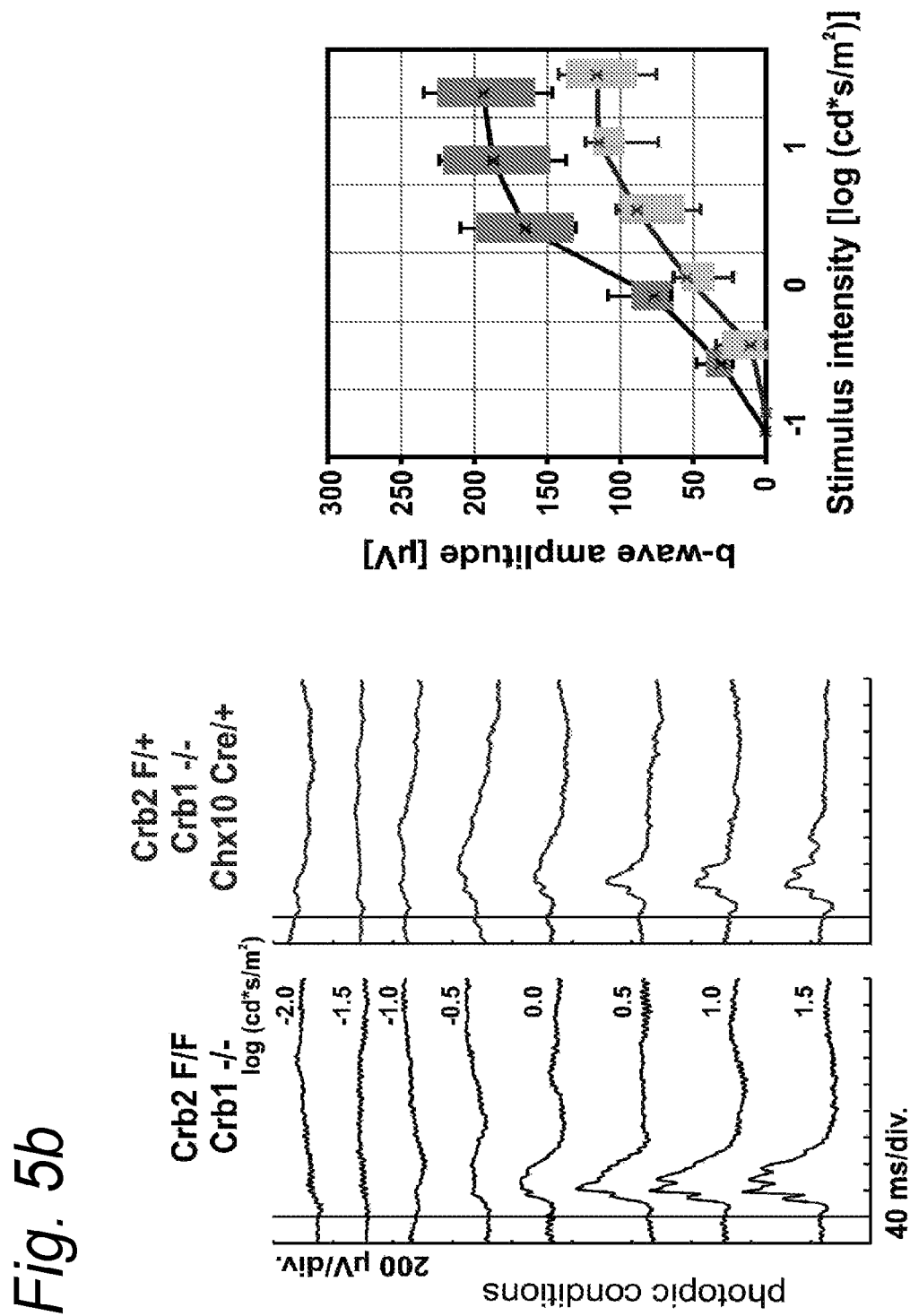

In $Crb1^{-/-}Crb2^{F/+}Chx10Cre/+$ mice the morphological phenotype starts at P10 (FIG. 4), and a significantly decreased ERG is detected at 3 months of age (data not shown) and is very clear at 6 months of age (whereas no decrease is detected in $Crb1^{-/-}$ retinas). In these retinas, the dorsal (superior) part of the retina does not show retinal degeneration, whereas the ventral (inferior temporal and nasal) part does. This is in part reminiscent to $Crb1^{-/-}$ retinas in which only one quadrant (inferior temporal) and $Crb1^{rd8/rd8}$ retinas in which only one quadrant (inferior nasal) part of the retina shows (limited) retinal degeneration. These mice are useful for functionally testing our AAV CRB gene therapy vectors by electroretinography (ERG) since control double heterozygote $Crb1^{+/-}Crb2^{F/+}Chx10Cre/+$ retinas do not show a morphological or ERG phenotype. Unfortunately, the confidence intervals for control and mutant mice (on 50% C57BL/6J and 50% 129/Ola mixed genetic background) at 3 and 6 months of age are very close to each other, rendering the model difficult for interpreting (partial)

rescue studies. Crb1$^{-/-}$Crb2$^{F/+}$Chx10Cre/+ mice on 99.9% C57BL/6J background are being produced and will provide less inter-mouse variation. As described below, we consider Crb2$^{F/F}$Chx10Cre/+ retinas, which mimic loss of CRB1 in retinitis pigmentosa patients, as the best for rescue studies since their electroretinograms are easier to interpret.

Example 1

Expression of Short Human CRB1 in Immune Naïve CRB1 Knockout Retina is Toxic

It is important to note that there are alternative transcripts of the human CRB1 gene. One transcript, lacking exons 3 and 4 but maintaining the open reading frame, encodes a shorter form than full length CRB1 but is present in human (SEQ ID NO:3), and e.g. apes, monkeys, canine, equine, feline and many other species, however not in mice. Notably, the sequence of CRB2 (SEQ ID NO:40) is very similar to the sequence of this naturally occurring short variant of CRB1 (sCRB1 or sCRB1ΔE3/4). In our initial trials we generated AAV vectors with the CMV promoter, the short CRB1, a synthetic intron (In5) in the short CRB1 cDNA sequence, and a synthetic spA. Upon subretinal injection of this vector packaged in AAV serotype 9 (AAV9), we detected significant expression of short CRB1 at the "outer limiting membrane" in Müller glia cells and photoreceptors. Similarly, results were obtained with vector packaged in AAV serotype 5 (AAV5). We subretinally injected 1 μl of AAV2/9-CMV-hCRB1ΔE3/4In5-spA ($1.00\times10^{10}$ delivered vector genomes) plus a ten-fold lower dose of AAV2/9-CMV-GFP-WPRE-pA ($1.00\times10^{9}$ delivered vector genomes) into the left eye of retinas lacking CRB1 with reduced levels of CRB2 (Crb1$^{-/-}$Crb2$^{flox/+}$Chx10Cre retinas). The contralateral control eye received one μl of AAV2/9-CMV-GFP-WPRE-pA ($1.00\times10^{10}$ delivered vector genomes). Crb1$^{-/-}$Crb2$^{flox/+}$Chx10Cre retinas show progressive loss of retinal function from 1 to 3 to 6 months of age (data not shown). The treated eyes showed expression of short CRB1 in a large region of the retina at the "outer liming membrane" of Müller glia cells and photoreceptors, and in retinal pigment epithelium. However, using two independently generated batches of the viral particles, we detected loss of the photoreceptor layer as well as retinal pigment epithelium layer due to expression of the short variant of CRB1 in Müller glia cells or photoreceptors or retinal pigment epithelium both by histochemistry and by immunohistochemistry. The cause of these toxic effects is to be further analysed and may for example be e.g. an immune-response in the CRB1 naïve Crb1 knockout retina, ectopic expression effect, incompatibility of mouse and human CRB1 protein, differences between short and full length CRB1, interference of short CRB1 with the expression of other CRB1 transcripts or proteins, dose-dependent toxicity, untimely expression of short CRB1), and it might be related to the inability in producing continuous high level expression of short (or full length) CRB1 in cultured cell lines. Preliminary studies expressing the short CRB1 in wild-type C57BL/6J retina showed toxicity as well, suggesting that the toxicity is not only due to the expression of short human CRB1 in immune-naïve Crb1 knockout retina. This urged us to test expression of CRB2 in a therapeutic vector, since CRB2 expression was well tolerated in cell lines. Expression of CRB2 in Müller glia cells or photoreceptor cells or retinal pigment epithelium did not result in toxic effects. More specifically, expression of CRB2 in Muller glia cells or photoreceptor cells or retinal pigment epithelium did not result in a detectable loss of the photoreceptor layer and/or the retinal pigment epithelium layer. This lack of toxic effects of CRB2 expression in Müller glia cells and photoreceptor cells and retinal pigment epithelium is relevant to the development of future clinical applications. Note that we used very high levels of AAV-CRB2 vector ($10^{10}$ delivered vector genomes) but toxic effects were not detected.

Example 2

AAV-Mediated Gene Therapy Restores Visual Function and Behavior in a Mouse Model of Retinitis Pigmentosa (RP) Due to Loss of Crumbs Homologue (CRB) Function In this example, the inventors evaluated whether delivery of a species-specific version of Crumbs homologue (CRB) (i.e., human) to Müller glia cells and photoreceptors of the postnatal Crb2 cKO mouse could restore function to these cells. Serotype 6 (variant ShH10Y) AAV vectors were used to deliver human CRB2 subretinally to Müller glia cells and photoreceptors of postnatal day 23 (P23) Crb2 cKO mice. Electroretinogram (ERG) and behavioral testing were used to assess visual function and immunocytochemistry was used to examine therapeutic transgene expression, Crumbs homologue (CRB) complex protein localization and preservation of retinal structure in treated and untreated eyes.

This example demonstrates that an AAV vector subretinally delivered to the left eyes of P23 Crb2 cKO mice facilitated expression of wild-type CRB2, restoration of visual function and behavior, and preservation of rod and cone photoreceptors. Ten weeks following injection, retinal function (ERG) was analyzed in treated and untreated eyes. In some experiments, ERG was performed every two weeks after 4 weeks until 10 weeks post injection (the latest time point evaluated). At 10 weeks post injection, all animals were sacrificed and their treated and untreated retinas were evaluated for expression of CRB2 and localization of Crumbs homologue (CRB) complex proteins.

The results confirm that rod-mediated and cone-mediated function was restored to treated eyes of Crb2 cKO mice (ERG a-wave and b-wave amplitudes were about twice better than in the untreated eyes). Moreover, the treatment effect was stable for at least 10 weeks post-administration. Histology revealed AAV-mediated CRB2 expression in Müller glia cells and photoreceptors and a restoration of Crumbs homologue (CRB) complex protein location in treated mice. In addition, cone cell densities were higher in treated eyes than untreated contralateral controls. This result suggests that treatment is capable of preserving cone and rod photoreceptors for at least 10 weeks post treatment. This is the first demonstration that postnatal gene therapy is capable of restoring visual function and behavior to, and preserving retinal structure in, a mammalian model of RP due to mutations in the Crumbs homologue gene. Importantly, results were obtained using a well characterized, clinically relevant AAV vector; the in vivo animal model data thus obtained provide the foundation for an AAV-based gene therapy vector for treatment of children affected with LCA8 and/or RP due to mutations in the CRB1 gene.

2.1. Materials and Methods:
Experimental Animals:
Crb2(flox/flox) mice were generated at the inventor's facilities. Chx10Cre heterozygote embryos were obtained from a living stock at The Jackson Laboratory (Bar Harbor, Me., USA). Heterozygotes were mated at the inventors' facilities to produce Crb2(flox/flox)Chx10Cre homozygous mice and isogenic Crb2(flox/+)Chx10Cre control offspring (both heterozygous for Chx10Cre). All mice were bred and maintained in a centralized facility at the inventors' institution under a 12 hr/12 hr light/dark cycle. Food and water were available ad libitum. All animal studies were approved by the local Institutional Animal Care and Use Committee and conducted in accordance with the ARVO Statement for the Use of Animals in Ophthalmic and Vision Research and KNAW (Koninklijke Nederlandse Akademie van Wetenschappen) regulations.

Construction of AAV Vectors:

AAV vectors with serotype 6 variant ShH10Y capsid proteins and AAV2 ITR and Rep proteins (AAV2/ShH10Y) were used to deliver human CRB2 (hCRB2) as they have been shown to exhibit robust transduction efficiency and a faster onset of expression in retinal Müller glia cells as well as photoreceptors than other AAV serotypes. The serotype 6 variant ShH10Y AAV capsid was provided by Dr. John Flannery (University of California, Berkeley, Calif., USA). AAV serotype 5 was obtained from Plasmid Factory. AAV serotype 9 was obtained from Dr. Joost Verhaagen (Netherlands Institute for Neuroscience). A ubiquitous cytomegalovirus (CMV) promoter was selected to drive expression of hCRB2. The nucleic acid sequence of an illustrative ubiquitous CMV promoter which was used in the studies is shown in SEQ ID NO: 121. The CMV promoter is flanked at the 5' sequence with a BglII restriction site (AGATCT). A synthetic intron (In5) inserted in the CRB2 cDNA was used for stable transcript processing of CRB2. The nucleic acid sequence of an illustrative synthetic intron (In5) in the coding sequence of the Crumbs homologue (CRB) gene is shown in SEQ ID NO: 128. The intron was inserted into CRB2 cDNA between two adjacent exons with a sequence of exon NNNAG/intron/GNNN exon, where G, A, T, C stands for one of the four nucleotides, and N stands for any of the four nucleotides. A synthetic poly-adenylation (spA) sequence was used for efficient termination of transcription. The nucleic acid sequence of an illustrative synthetic poly-adenylation region (Levitt et al., 1989) in between the stop codon behind the translated region of the Crumbs homologue (CRB) gene and the 3' flanking inverted terminal repeat which was used is shown in SEQ ID NO: 129. The synthetic polyadenylation site is flanked at the 3' sequence with a BglII restriction site (AGATCT). The nucleic acid sequence of an illustrative 5' untranslated region located in between the CMV promoter and the translated region of the Crumbs homologue (CRB) gene which was used is shown in SEQ ID NO: 130.

The CMV-hCRB2In5-spA fragment, containing BglII restriction sites at the 5' and 3' ends, with sequence identified in SEQ ID NO:40 was synthesized by GenScript (Piscataway, N.J., USA). The BglII CMV-hCRB2In5-spA fragment was cloned into pUC57 (Thermo Fisher Scientific, Waltham, Mass., USA) containing two inverted terminal repeats (ITRs) of AAV2 flanked by BglII restriction sites (SEQ ID NO: 131 and 132). The resulting AAV-hCRB2 plasmid of 4.9 kb contained the sequence identified in SEQ ID NO:40 and was sequence verified.

AAV vectors were packaged and purified by iodixanol gradient ultra-centrifugation according to previously published methods (Zolotukhin et al., 1999; Hermens et al., 1999; Ehlert et al., 2010). Viral particles were diluted, washed and concentrated using an Amicon 100 kDa MWCO Ultra-15 device (Millipore, Billerica, Mass., USA) in Dulbecco's Balanced Salt Solution (Life Technologies, Bleiswijk, Netherlands) and titered by quantitative real-time PCR (Aartsen et al, 2010). Resulting titers were $1.00 \times 10^{13}$ viral genomes per ml (vg/ml) for AAV2/ShH10Y-CMV-hCRB2 or AAV2/9-CMV-hCRB2 (AAV2 ITR and Rep proteins; AAV9 capsid proteins) or AAV2/5-CMV-hCRB2 (AAV2 ITR and Rep proteins; AAV5 capsid proteins).

Subretinal Injections:

In a typical experiment, one μl of AAV2/ShH10Y-CMV-hCRB2 ($1.00 \times 10^{10}$ delivered vector genomes) plus a tenfold lower dose of AAV2/ShH10Y-CMV-GFP-WPRE-pA ($1.00 \times 10^9$ delivered vector genomes) was delivered subretinally at postnatal day 23 (P23) to the left eye of each Crb2(flox/flox)Chx10Cre mouse. The contralateral control right eye was injected with one pi of AAV2/ShH10Y-CMV-GFP-WPRE-pA ($1.00 \times 10^{10}$ delivered vector genomes). Subretinal injections were performed as previously described (Aartsen et al., 2010). Further analysis was carried out on all animals, not only the ones which received comparable, successful injections (>60% retinal detachment and minimal complications). It is well established that the area of retinal detachment corresponds to the area of viral transduction (Cideciyan et al., 2008; Timmers et al., 2001).

Electroretinographic Analysis:

In a representative experiment, electroretinograms (ERGs) of treated Crb2 cKO (n=3) and isogenic controls (n=2) were recorded using a PC-based control and recording unit (Toennies Multiliner Vision; Jaeger/Toennies, Hochberg, Germany) according to methods previously described with minor modifications (Haire et al., 2006). Initial ERG measurements were recorded at 4 weeks' postinjection, and each subsequent 2 weeks thereafter, until 10 weeks post-injection (the latest time point evaluated in the study). Age matched isogenic controls were recorded alongside treated animals at every time point. Mice were dark-adapted overnight (more than 12 hours) and anesthetized with a mixture of 100 mg/kg ketamine, 20 mg/kg xylazine and saline in a 1:1:5 ratio, respectively. Pupils were dilated with 1% tropicamide and 2.5% phenylephrine hydrochloride. A heated circulating water bath was used to maintain the body temperature at 38° C. Hydroxypropyl methylcellulose 2.5% was applied to each eye to prevent corneal dehydration. Full-field ERGs were recorded using custom, gold wire loop corneal electrodes. Reference and ground electrodes were placed subcutaneously between the eyes and in the tail, respectively. Scotopic rod recordings were elicited with a series of white flashes of seven increasing intensities (0.1 mcds/m$^2$ to 1.5 cds/m$^2$). Interstimulus intervals for low intensity stimuli were 1.1 second. At the three highest intensities (100 mcds/m$^2$, 1 cds/m$^2$ and 5 cds/m$^2$), interstimulus intervals were 2.5, 5.0 and 20.0 seconds, respectively. Ten responses were recorded and averaged at each intensity. Mice were then light adapted to a 100 cds/m$^2$ white background for 2 min. Photopic cone responses were elicited with a series of five increasing light intensities (100 mcds/m$^2$ to 12 cds/m$^2$). Fifty responses were recorded and averaged at each intensity. All stimuli were presented in the presence of the 100 cds/m$^2$ background. B-wave amplitudes were defined as the difference between the a-wave troughs to the positive peaks of each waveform.

Alternatively, ERGs recordings were elicited with a series of light pulses of increasing intensities (2.7 cds/m$^2$ to 25 cds/m$^2$, logarithmically spread over 10 levels. Pulse lengths ranged from 0.5 to 5 msec. Between pulses there was a delay of approximately 2 seconds (0.5 Hz). Thirty responses were recorded and averaged at each intensity. No extra delay was introduced for the transition from one intensity level to the next. Between pulses, no background lighting was present. The a-wave trough was defined as the minimum response between 0 and 30 milliseconds after stimulus onset. The b-wave peak was defined as the maximum response between 15 and 100 milliseconds after stimulus onset. The a-wave amplitude was defined as the difference between the baseline and the a-wave trough, whereas the b-wave amplitude was defined as the difference between the b-wave peak and the a-wave trough.

Photopic b-wave maximum amplitudes (those generated at 12 cds/m2) of all CMV-hCRB2-treated (n=3) Crb2 cKO (both treated and untreated eyes) and isogenic control mice were averaged and used to generate standard errors. These calculations were made at every time point (4 weeks' to 10 weeks' post-injection). This data was imported into Sigma Plot for final graphical presentation. The paired t-test was used to calculate P-values between treated and untreated eyes within each group over time (4 weeks post-injection vs. 10 weeks post-injection). Significant difference was defined as a P-value<0.05.

Tissue Preparation:

Ten weeks post-injection, P23-treated Crb2 cKO mice and age matched isogenic controls were dark adapted for 2 hr. Immediately following dark adaptation, mice were sacrificed under dim red light (>650 nm). The limbus of injected and un-injected eyes was marked with a hot needle at the 12:00 position, facilitating orientation. Enucleation was performed under dim red light and eyes were placed immediately in 4% paraformaldehyde. Eyes that were to be used for cryosectioning were prepared according to previously described methods (Haire et al., 2006). Briefly, corneas were removed from each eye, leaving the lens inside the remaining eye cup. A small "V" shaped cut was made into the sclera adjacent to the burned limbus to maintain orientation. After overnight fixation, the lens and vitreous were removed. The remaining retinal RPE-containing eyecup was placed in 30% sucrose in PBS for at least 1 hr at 4° C. Eyecups were then placed in cryostat compound (Tissue Tek OCT 4583; Sakura Finetek, Inc., Torrance, Calif., USA) and snap-frozen in a bath of dry ice/ethanol. Eyes were serially sectioned at 10 µm with a cryostat (Microtome HM550; Walldorf, Germany). Eyes that were to be used for whole mount analysis were prepared according to previously described methods (van de Pavert et al., 2007). Orientation was achieved as previously mentioned. After overnight fixation, cornea, lens, vitreous and retinal pigment epithelia were removed from each eye without disturbing the retina. A cut was made in the superior (dorsal) portion of the retina adjacent to the original limbus burn to maintain orientation.

Immunohistochemistry and Microscopy:

Retinal cryosections and whole mounts were washed 3× in 1×PBS. Following these washes, samples were incubated in 0.5% Triton X-100® for 1 hr in the dark at room temperature. Next, samples were blocked in a solution of 1% bovine serum albumin (BSA) in PBS for 1 hr at room temperature. Retinal sections were incubated overnight at 37° C. with a rabbit polyclonal CRB2 antibody EP13 or SK11 (1:1000 and 1:200, respectively; provided by Dr. Penny Rashbass, University of Sheffield, UK) diluted in 0.3% Triton X-100®/1% BSA. Following primary incubation, retinal sections and whole mounts were washed 3× with 1×PBS.

Retinal sections were incubated for 1 hr at room temperature with IgG secondary antibodies tagged with Cyanine dye Cy5 (Molecular Probes, Eugene, Oreg., USA) diluted 1:500 in 1×PBS. Following incubation with secondary antibodies, sections and whole mounts were washed with 1×PBS. Retinal sections were counterstained with 4',6'-diamino-2-phenylindole (DAPI) for 5 min at room temperature. After a final rinse with 1×PBS and water, sections were mounted in an aqueous-based medium (DAKO) and cover-slipped. Retinal whole mounts were oriented on slides with the superior (dorsal) portion of the retina positioned at the 12:00 position. Samples were mounted in DAKO and cover-slipped.

Retinal sections were analyzed with confocal microscopy (Leica TCS SP5 AOBS Spectral Confocal Microscope equipped with LCS Version 2.61, Build 1537 software, (Bannockburn, Ill., USA). All images were taken with identical exposure settings at either 20× or 63× magnification. Excitation wavelengths used for DAPI and CRB2 stains were 405 nm and 650 nm, respectively. Emission spectra were 440-470 nm and 670 nm, respectively. Retinal whole mounts were analyzed with a widefield fluorescent microscope (Axioplan 2) (Zeiss, Thornwood, N.Y., USA) equipped with a QImaging Retiga 4000R Camera and QImaging QCapture Pro software (QImaging, Inc., Surrey, BC, Canada). Quadrants of each whole mount were imaged at 5× under identical exposure settings and then merged together in Photoshop® (Version 7.0) (Adobe, San Jose, Calif., USA).

2.2. Results

Figure 10A:
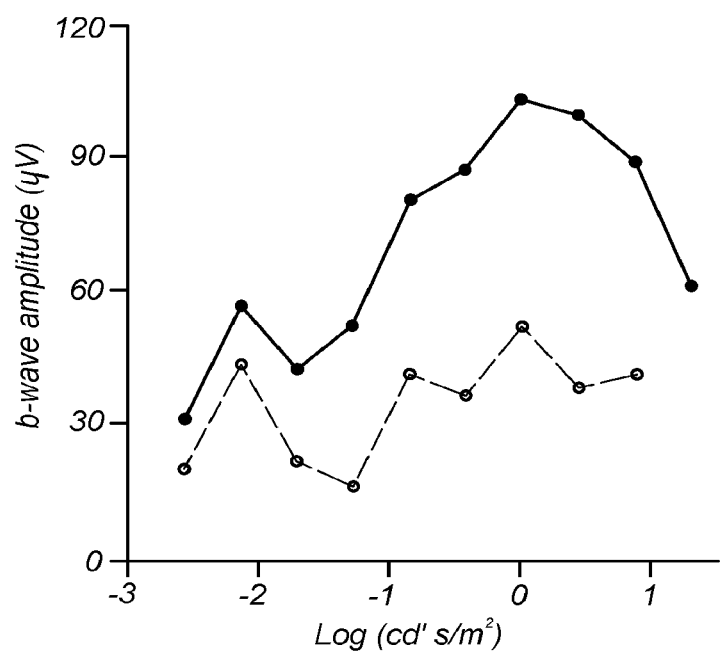
FIG. 10. Representative experiment showing rescue of loss of retinal activity. Crb2 cKO retinas were injected at postnatal day 23 subretinally with 10$^{10}$ AAV2/ShH10Y-CMV-CRB2 or AAV2/ShH10Y-CMV-GFP viral particles and analyzed for ERG and immunohistochemistry at 3 months of age. Panel a, electroretinogram scotopic b-wave showing rescue of retinal activity in the right Crb2 cKO eye transduced with AAV2/ShH10Y-CMV-CRB2 (dark line), compared to the left eye of the same Crb2 cKO transduced with AAV2/ShH10Y-CMV-GFP (faint line). The scotopic a-wave is also rescued (data not shown). Panel b, immunohistochemistry showing expression of sCRB1 in the right eye of the animal used in panel a. No expression of CRB2 was detected in the left eye of the same animal. Abbreviations: OLM, outer limiting membrane; RPE retinal pigment epithelium.
Figure 10B:
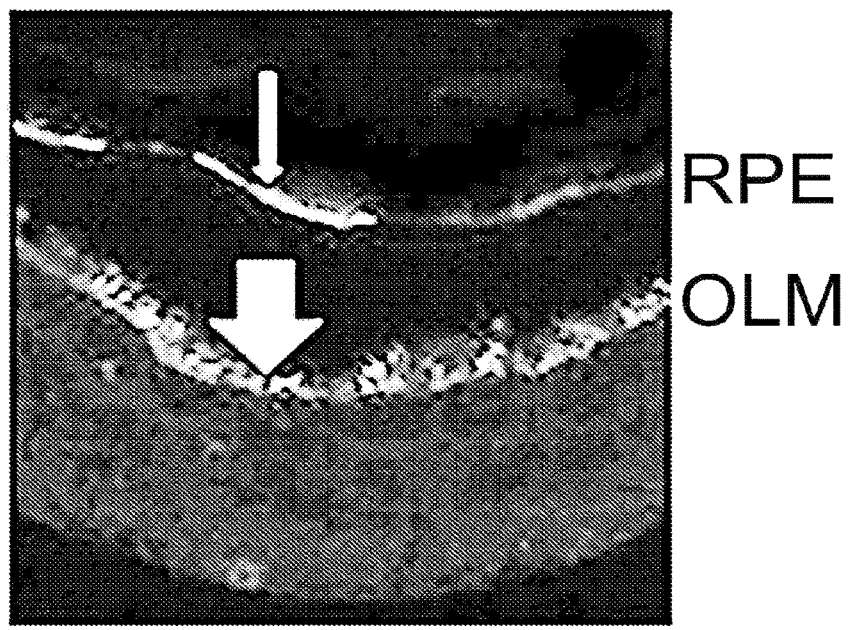
Figure 11:
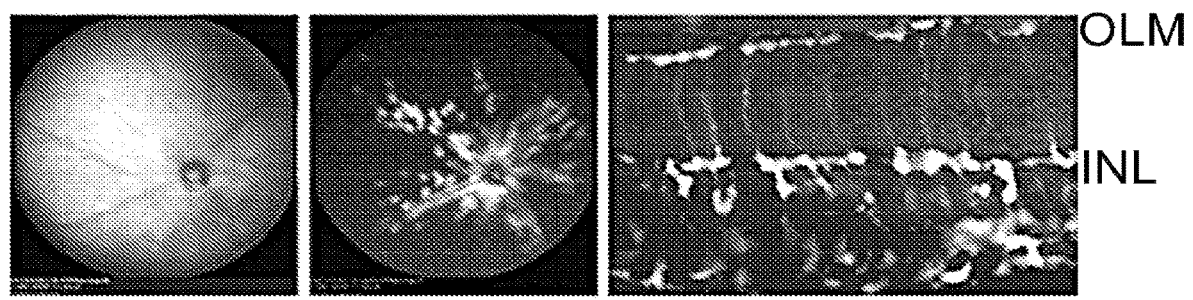
FIG. 11. Specific transduction of Müller glia cells using 10$^{10}$ AAV2/6-RLBP1-GFP viral particles containing the human RLBP1 promoter (SEQ ID NO. 122) upon intravitreal injection (specific infection of Müller glia cells). Retinas were collected 3 weeks post-infection. Panel a, scanning-laser-ophtalmoscopy (SLO). Panel b, SLO showing fluorescent cells. Panel c, immunohistochemistry showing specific expression of GFP in Müller glia cells.

Photoreceptor Function (ERG) was Restored in AAV-Treated Crb2 cKO Mice:

It was previously reported that rod and cone responses in the Crb2 cKO mouse are significantly decreased at 1 month of age and progressively decreased at 3 months of age (Alves et al., 2013). Here, the inventors have shown that P23-treatment of this mouse with an AAV vector carrying the human CRB2 gene (SEQ ID NO:40) under the control of a ubiquitous (CMV) promoter led to substantial restoration of rod photoreceptor function as measured by electroretinography (ERG). Representative rod traces from CMV-hCRB2-treated and control CMV-GFP treated eyes showed that rod function in CMV-hCRB2 treated eyes was restored to approximately 40% of normal at 10 weeks post-injection. Similar to previous reports, rod responses in contralateral, untreated eyes were about 20% of normal by this time point. Importantly, restoration of rod photoreceptor a-wave and b-wave function remained stable at 3 months (the latest time point evaluated in this study (see FIG. 10). Rod retinal function (ERG) is partially preserved in the Crb2 cKO mouse. Studies have shown that even very small ERG amplitudes translate into robust visual behavior (Williams et al., 2006). In fact, LCA2 patients who received AAV-RPE65 therapy were found to exhibit behavioral restoration despite a complete lack of ERG response (Maguire et al., 2008). So, the rescue of loss of retinal function in Crb2 cKO retinas by the AAV-hCRB2 vector is very promising for future gene therapy studies. This is the first example of rescue of loss of retinal function in mammalians lacking Crumbs homologue (CRB) function using a candidate clinical gene therapy vector.

Analysis was carried out on all animals, not only the ones which received comparable, successful injections (>60% retinal detachment and minimal complications). It is well established that the area of retinal detachment corresponds to the area of viral transduction (Cideciyan et al., 2008; Timmers et al., 2001). Mice with unsuccessful subretinal injections showed lack or limited expression of hCRB2 and GFP in combination with lack of rescue of scotopic b-wave or a-wave ERG function (see FIG. 10). Due to the inter-mouse variability in untreated Crb2 cKO rod responses (60-80% of WT by 3 months of age), statistical comparison of average rod responses of treated vs. untreated eyes is problematic. However, within an animal, rod ERG amplitudes are nearly equal between partner eyes, therefore we calculated the average intra-mouse rod a- and b wave amplitude ratios for treated versus untreated eyes and then plotted these ratios over time.

Figure 12:
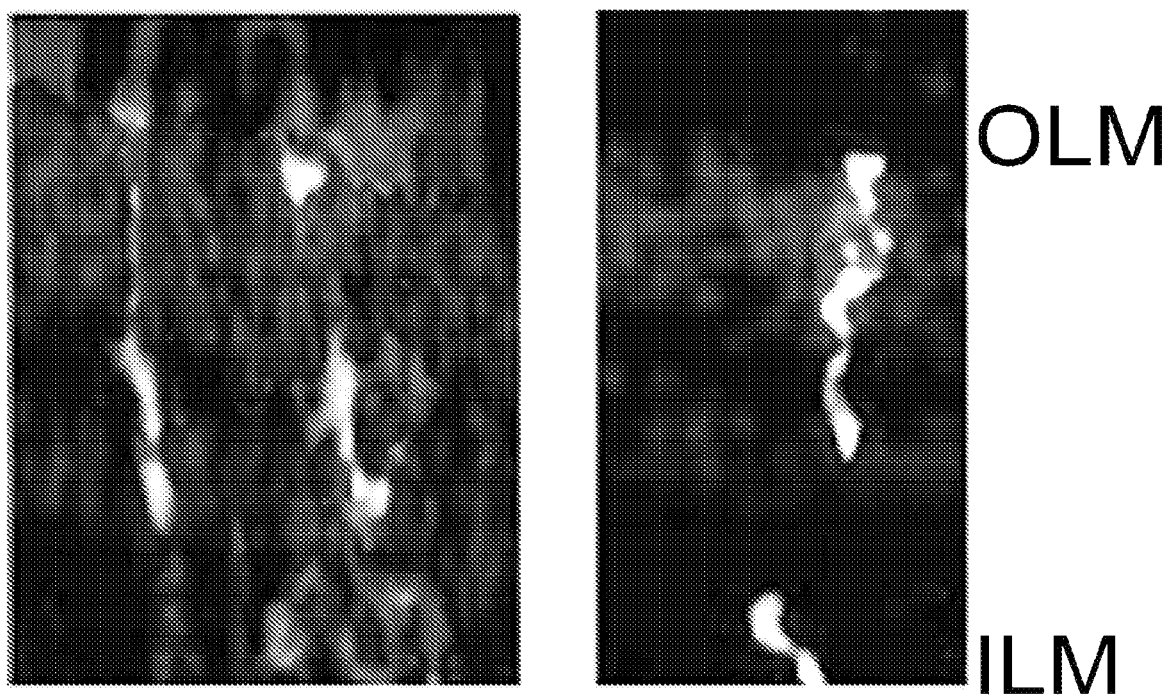
FIG. 12. AAV6 and ShH10Y capsids transduce adult human Müller glia cells. One μl $10^{13}$ genome copies per ml of AAV2/6-CMV-GFP-WPRE-pA (panel a) or AAV6 variant AAV2/ShH10-CMV-GFP-WPRE-pA (panel b) was applied to pieces of cultured adult human retina. GFP expression was detected in Müller glia cells.

The Ubiquitous CMV Promoter Drives hCRB2 Transgene Expression in Müller Glia Cells and Photoreceptors of Crb2 cKO Mice:

CRB1-deficiency affects both Müller glia and photoreceptors in LCA8 and RP patients due to mutations in the CRB1 gene. The ubiquitous CMV promoter was therefore chosen for this study as a means of targeting both cell types. The AAV6 variant ShH10Y capsid was chosen because it infects upon subretinal injection efficiently in vivo mouse Müller glia and photoreceptors (and infects e.g. in vitro human retinal Müller glia cells, see FIG. 12). Immunostaining of Crb2 cKO retinas 10 weeks posttreatment with AAV-CMV-hCRB2 revealed that this promoter drove robust hCRB2 expression in inner segments of photoreceptors and apical villi of Müller glia cells. Typically, a retinal cross section from an eye injected with this therapeutic vector shows intense hCRB2 staining at the outer limiting membrane whereas the contralateral, mock GFP treated eye from the same mouse lacks any hCRB2 expression. Levels of CMV-mediated hCRB2 expression approached that seen in isogenic control eyes. hCRB2 expression in CMV-hCRB2-treated neural retina was restricted to the outer limiting membrane. hCRB2 expression was occasionally found in the retinal pigment epithelium. In normal mammalian retinas, the retinal pigment epithelium also expresses Crumbs homologue (CRB) complex members such as PALS1 (Park et al., 2011), albeit at lower levels than at the outer limiting membrane (Pellissier L P, Lundvig D M, Tanimoto N, Klooster J, Vos R M, Richard F, Sothilingam V, Garcia Garrido M, Le Bivic A, Seeliger M W, Wijnholds J. Hum Mol Genet. 2014 Jul. 15; 23(14):3759-71). Overexpression of hCRB2 in the wild-type RPE cells in the Crb2 cKO did not result in noticeable altered morphology or function of retinal pigment epithelium. Notably however, the CMV promoter construct did not drive therapeutic hCRB2 expression outside the photoreceptor cells, Müller glia cells and retinal pigment epithelium. This lack of off target expression is relevant to the development of future clinical applications. If required, overexpression in retinal pigment epithelium can be decreased by the use of micro-RNA target sites (miRT's) specific for miRNAs expressed in retinal pigment epithelium cells (Karali et al., 2011).

It is important to note that while CRB1-deficiency in humans causes LCA8 and progressive RP very well detectable by ERG, CRB1-deficiency in mice causes late-onset retinal degeneration and degeneration limited to one quadrant of the retina and not detectable by ERG. Our immuno-electron microscopy data showed that in mice CRB1 is restricted to the "outer limiting membrane" of Müller glia cells, whereas in humans CRB1 is localized to the "outer limiting membrane" of Müller glia cells and photoreceptors. Our immuno-electron microscopy data showed that in mice CRB2 is localized to the "outer limiting membrane" of Müller glia cells and photoreceptors, whereas in humans CRB2 is restricted to the "outer limiting membrane" of Müller glia cells. Our analysis of mice lacking CRB1, mice lacking CRB2, mice lacking CRB1 with reduced levels of CRB2, mice lacking CRB2 with reduced levels of CRB1, and mice lacking both CRB1 and CRB2 suggest very similar functions for CRB1 and CRB2. Similarly, the functions of Crumbs homologue (CRB) proteins are exchangeable e.g. the human CRB1 protein can rescue partially the phenotype in fruit flies lacking Crumbs (Crb) protein (den Hollander et al., 2001), and the zebrafish CRB2B protein can rescue the phenotype in zebrafish lacking CRB2A protein (Omori & Malicki, 2006).

2.3. Discussion

Prior to Examples 1 and 2, several plasmids were transfected as naked plasmid DNA in cell lines (e.g. HEK293, MDCKII and ARPE19 cell lines) as described in section 3.1 MATERIALS AND METHODS. It was apparent that the transfected cell lines with short or full length CRB1 cDNA consistently resulted in low CRB1 expression. Also cell lines (e.g. HEK293 and MDCKII cell lines) that stably express full length CRB1 cDNA (SEQ ID NO:1) or short CRB1 cDNA (CRB1 lacking the entire extracellular domain; SEQ ID NO:3) had a low expression. In contrast, cell lines expressing CRB2 cDNA resulted in high expression of CRB2 protein. These observations indicate that cells handle increased expression of CRB2 better than increased expression of CRB1.

Experiments have been carried out in several mouse models.

Short human CRB1 was overexpressed in retinas lacking CRB1 protein expression and with reduced levels of CRB2 protein. Thus, these mice still have functional native CRB2 protein in Müller glia cells and photoreceptor cells since CRB2 in mouse retina is present in both cell types. It is conceivable that this remaining mouse CRB2 protein is capable of taking over the function of the CRB1 protein. These mice on 50% C57BL/6J and 50% 129/Ola genetic background were less suitable to test rescuing of the phenotype in the retina. Control mice and mutant mice are significantly different in retina activity as measured using electroretinography. However, there is quite some variation in experimental animals and as a consequence the confidence intervals are close to one another. As far as rescuing the phenotype is concerned, the mouse model is still suboptimal and could be further optimized by backcrossing to 99.9% C57BL/6J. Recently, trials were initiated in mice (on 75% C57BL/6J and 25% 129/Ola genetic background) lacking CRB1 and having reduced levels of CRB2 using human CRB2 in AAV9 conform to the experimental setting as outlined above. As with the described AAV2/ShH10Y-CMV-CRB2 experiments, ERG rescue results were obtained using AAV2/9-CMV-CRB2 ($1.00 \times 10^{10}$ delivered vector genomes) viral particles subretinally injected into P14 Crb1$^{-/-}$Crb2$^{F/+}$ Chx10Cre retinas (on 75% C57BL/6J and 25% 129/Ola genetic background) that were analyzed at 4 months of age.

Figure 1:
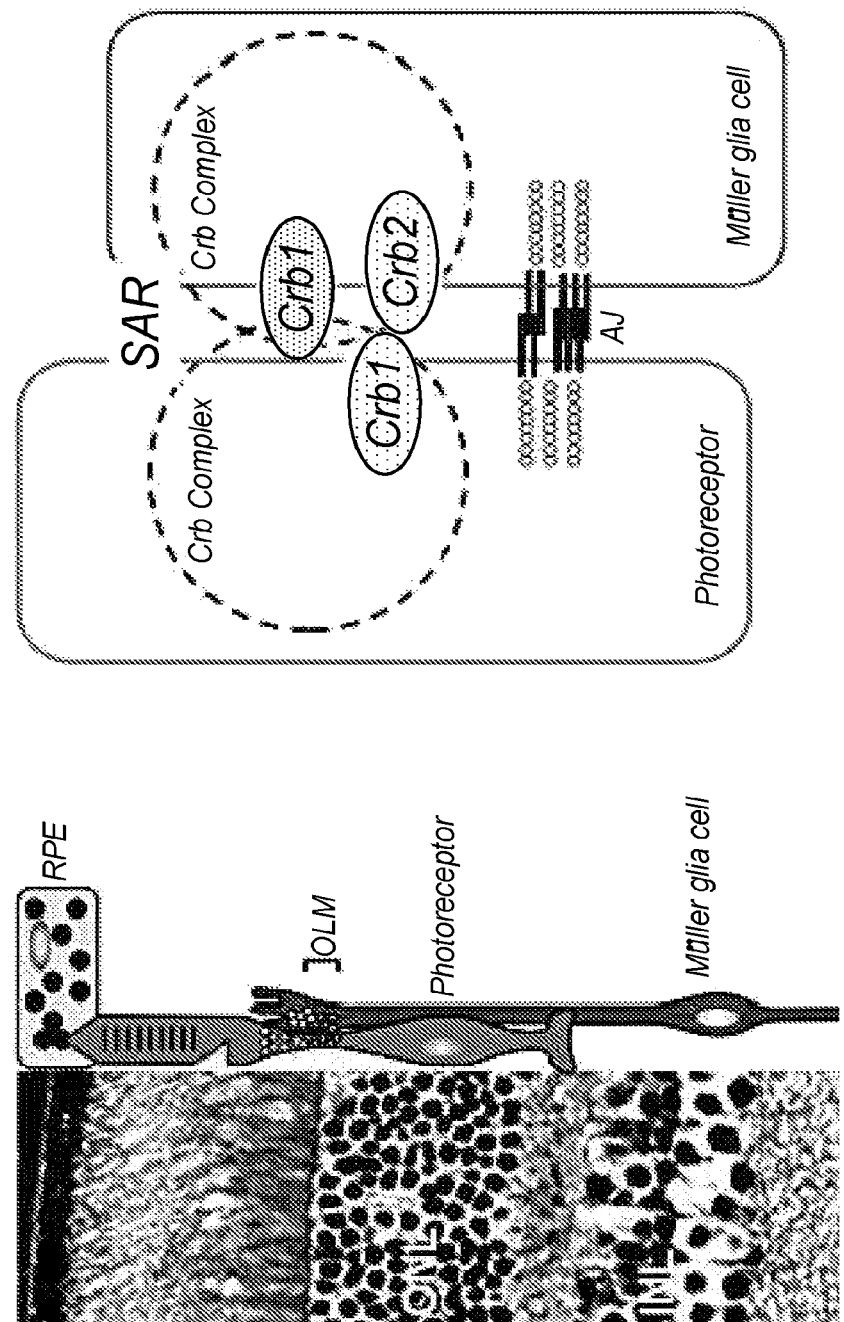
FIG. 1. A representative presentation of the localization of CRB1 in the human retina.
Figure 2:
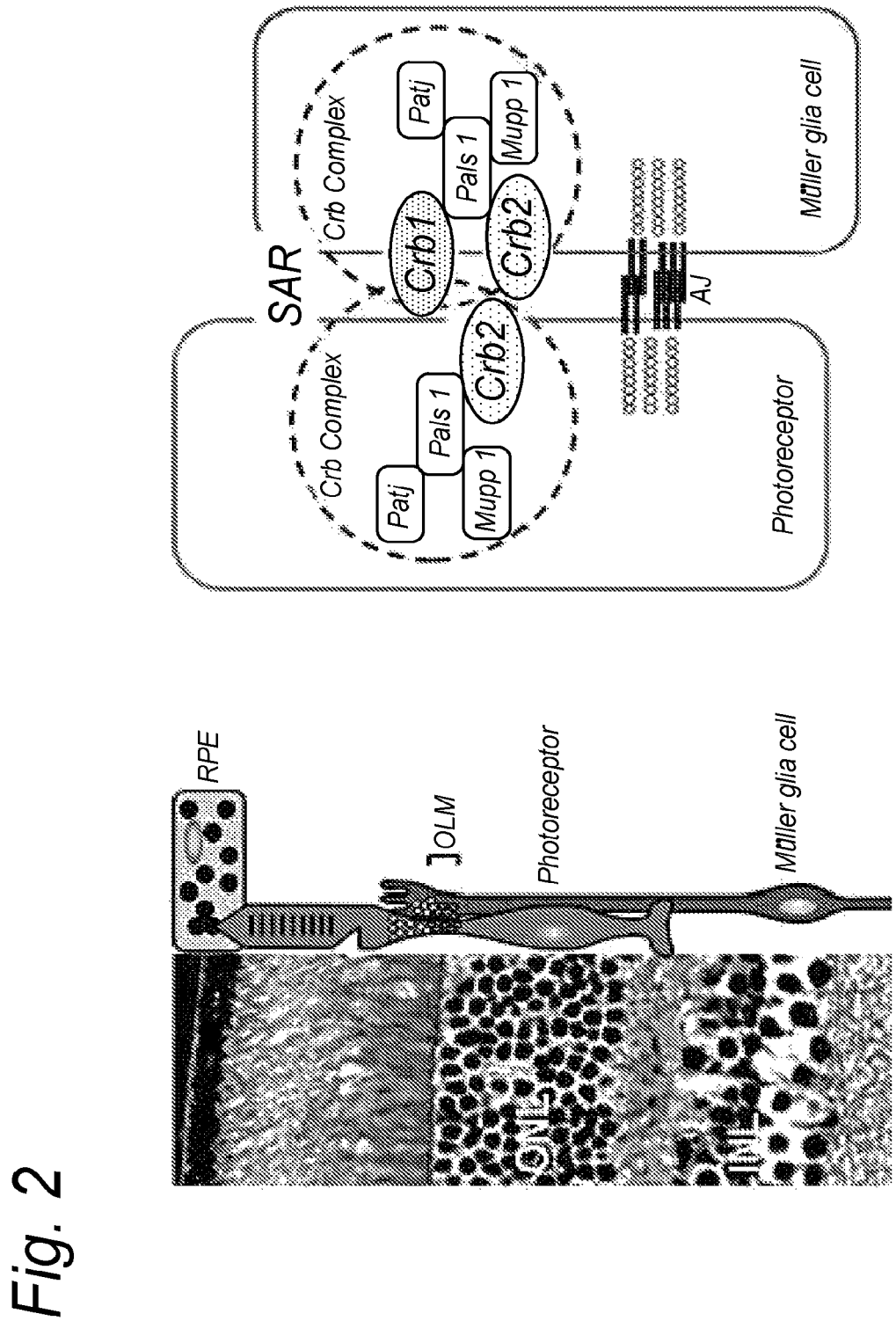
FIG. 2. A representative presentation of the localization of CRB1 in the mouse retina.
Figure 3:
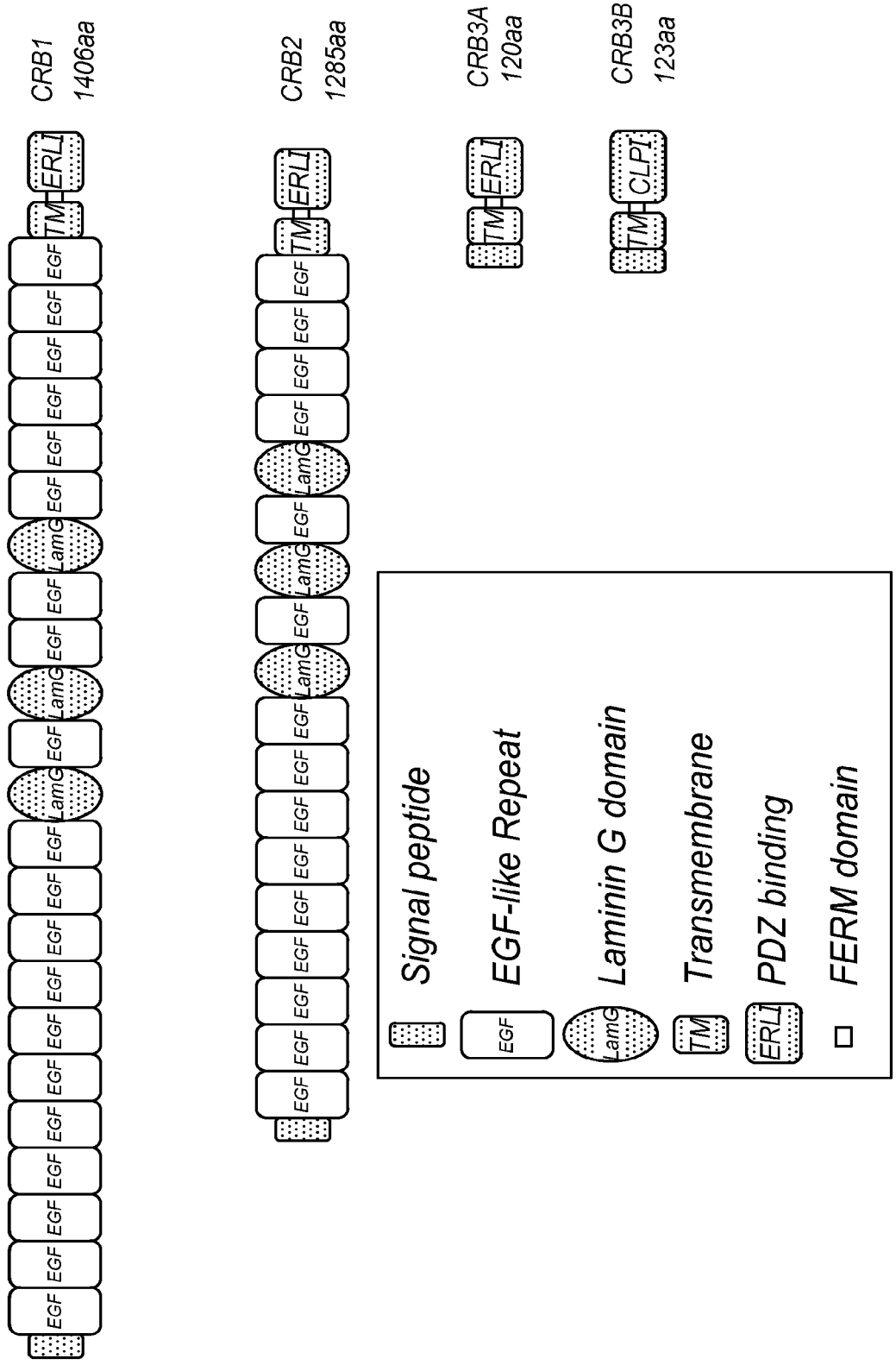
FIG. 3. A representation of the mammalian Crumbs homologue protein family.

Human CRB2 was overexpressed in retinas of mice lacking CRB2. These mice still have functional CRB1 protein in Müller glia cells, but lack functional CRB protein in photoreceptor cells. This situation most closely resembles the situation as seen in patients suffering from RP12 or LCA8. In these patients (lacking functional CRB1), CRB2 is present in Müller glia cells, but not in photoreceptor cells (see also FIGS. 1 and 2). Retinas of Crb2 conditional knock-out mice show a big difference in retina activity at 1 and 3 months of age. The retinas of Crb2 mutant mice are rescued phenotypically, and the confidence intervals are separated and well interpretable.

Human CRB2 was overexpressed in retinas of mice lacking CRB1 and with reduced levels of CRB2 (Crb1$^{-/-}$Crb2$^{F/+}$Chx10Cre). These mice lack CRB1 in the retina, but still have reduced levels of functional CRB2 protein in Müller glia cells and photoreceptor cells. This situation resembles mice lacking CRB1 (on a genetic background with reduced levels of CRB2). Retinas of control Crb2$^{F/+}$ conditional knock-out mice on 75% C57BL/6J and 25% 129/Ola genetic background do not show loss of retina activity compared to wild-type mice. Retinas of Crb1Crb2$^{F/+}$ conditional knock-out mice on 75% C57BL/6J and 25% 129/Ola genetic background show a big difference in retina activity at 3 months of age. The retinas of Crb1Crb2$^{F/+}$ mutant mice are rescued phenotypically, and the confidence intervals are separated and well interpretable. These experiments show that CRB2 can rescue a CRB1 phenotype in a mammalian disease model.

The present Example indicates that the phenotype, measured as retina activity using electroretinography, in the eyes that show expression of recombinant human CRB2 is rescued. In absence of expression of recombinant human CRB2 the phenotype is not rescued.

Experiments have been performed using several promoters. We have used the following promoter-gene constructs:
full length CMV-CRB2 (in rescue experiments in Crb2 cKO and Crb1Crb2(flox/+) cKO mice)
full length CMV-sCRB1 (in rescue experiments in Crb1Crb2(flox/+) cKO mice)
full length CMV-GFP (in expression experiments)
truncated CMV-GFP (in expression experiments)
truncated CMV-CRB1 (in rescue and toxicity experiments in Crb1Crb2(flox/+) cKO mice)
hGRK1-CRB1 (in expression experiments in Crb1 KO mice; the rescue and toxicity experiments will follow)
hRHO-CRB1 (in expression experiments in Crb2 KO mice; the rescue and toxicity experiments will follow)
hGRK1-CRB2 (in expression experiments in Crb2 cKO mice; the rescue experiments will follow)
hRHO-CRB2 (in expression experiments in Crb2 cKO mice; the rescue experiments will follow)
RLBP1-GFP (in expression experiments)

2.4. Conclusion

Long-term therapy is achievable in a mammalian model of Crumbs homologue (CRB) deficiency, the Crb2 cKO mouse, the Crb1Crb2$^{F/+}$ cKO mouse, using the rAAV vector CRB2 constructs disclosed herein. Importantly, these results could not be obtained by the use of short-CRB1 or full-length CRB1 constructs because of toxicity, whereas the results could be obtained with the non-toxic CRB2 constructs. Importantly, tools are present to test CRB2 gene therapy vectors in the mice lacking CRB1 and/or CRB2 which mimic different degrees of the LCA8 and RP due to loss of CRB1 phenotype. These results provide evidence for the successful use of rAAV-based CRB2 gene therapy vectors for treatment of retinal dystrophies, and LCA8 and RP due to loss of CRB1 in particular. Experiments have also been performed using AAV2/9-CMV-hCRB2-spA in rescue experiments, and AAV2/5-CMV-hRHO-CRB2-spA and AAV2/5-hGRK1-CRB2-spA in expression experiments, and also using the AAV2/9 vector, or hRHO or hGRK1 promoters, no toxicity was detected when overexpressing human CRB2, whereas overexpression of human short CRB1 in AAV5 or in AAV9 vectors was toxic.

Example 3

Toxicity Test of CRB Proteins in the ARPE-19 Cell Line by Cell Counting and Western Blotting 3.1. Materials and Methods Toxicity of CRB proteins can be tested using human-derived retinal pigment epithelial cells according to the following Example. ARPE19 cells (ATCC CRL-2302) are transfected with one of the different (modified) CRB constructs (e.g. CRB1, sCRB1, CRB2 isoform 1, CRB2 isoform 2, CRB2 isoform 3, CRB3 etc.) together with a control GFP construct (Aartsen et al. (2010) PLoS One 5:e12387; GFAP-driven transgene expression in activated Müller glial cells following intravitreal injection of AAV2/6 vectors; UniProtKB/Swiss-Prot sequence P42212) using the calcium phosphate method (described e.g. in Sambrook and Russell (2001) "Molecular Cloning: A Laboratory Manual (3$^{rd}$ edition), Cold Spring Harbor Laboratory, Cold Spring Harbor Laboratory Press, New York). As a control a CRB2 construct is used (CRB2 sequence: SEQ ID NO:40). The CRB constructs are used in equimolar amounts and a total amount of 20 µg of DNA is added per petridish. CRB constructs are made as described in Example 2.1. Briefly, CRB constructs are made by chemical synthesis and subcloned into pUC57. These constructs comprise AAV2 ITRs (SEQ ID NO:131 and 132), CMV promoter (SEQ ID NO:121), CRB cDNA to be tested (e.g. SEQ ID NO:40 or other CRB sequence, Intron 5 (SEQ ID NO: 128), and synthetic pA (SEQ ID NO:130). The GFP construct is used as internal transfection control in a fixed amount. For example, 18 µg of CRB construct plus 2 µg of GFP construct is used. In this way, a series of equimolar plasmid concentrations can be tested while adding the same amount of DNA, such as for example 2, 4, 8 or 16 µg of CRB construct, plus 18, 16, 12 or 4 µg of GFP construct, respectively.

On the day before transfection, ARPE19 cells are plated in duplicate at 30% of confluence in a 10 cm petridish in DMEM supplemented with 10% Fetal Bovine Serine and penicillin/streptomycin. After refreshing the medium 2 hours before transfection, the transfection mix is prepared with 20 µg of DNA in 500 µl of 0.25M CaCl$_2$ and TE (10 mM Tris, 1 mM EDTA pH 8) buffer per dish. While constantly vortexing, 500 µl of 2×HBS (281 mM NaCl, 100 mM Hepes, 1.5 mM Na$_2$HPO$_4$, pH 7.12) are added drop wise to the transfection mixture and the complete mix is directly added to the cells for overnight incubation. The medium is refreshed in the following morning. Two days later (i.e. 72 h after transfection), the attached and floating cells are harvested separately (one duplicate) and together (the second duplicate) and after centrifugation, resuspended in 1 mL of Phosphate Buffer Saline (137 mM NaCl, 2.7 mM KCl, 10 mM Na$_2$HPO$_4$ and 1.76 mM KH$_2$PO$_4$). Subsequently, cells are tested for:

Cell number and viability with a Luna Automated Cell Counter (Logos Biosystems, Inc.; Annandale, USA). The counter determines the number of cells and via Trypan Blue staining discriminates between viable and non-viable cells. Trypan Blue staining was performed using the Standard protocol by Life Technologies as outlined below.

Protein expression by Western Blotting. Proteins from the cell lysates are separated by SDS-page electrophoresis. After transfer to nitrocellulose membrane, the nitrocellulose membrane is immunostained for CRB, GFP and Actin proteins and analyzed by Odyssey Infrared Imaging System (LI-COR; Westburg BV, Leusden, the Netherlands). This method is described in the manual for Western Blot Analysis developed for Aerius, and Odyssey Family of Imagers by Li-Cor, published 2003, revised January 2012 (http://biosupport.licor.com/docs/Wester_Blot_Analysis_11488.pdf. As primary antibodies anti-CRB1 (AK2, AK5 and AK7; van de Pavert et al., 2004) and anti-CRB2 (SK II from Pen Rashbash, described in van de Pavert et al., 2004) and anti-GFP (Becton Dickinson and Company) were used. Secondary antibodies (IRDye 800-CW goat anti chicken, mouse or rabbit, or donkey anti goat) were from Li-Cor.

Trypan Blue Staining Using the Standard Protocol by Life Technologies:
Protocol The following procedure will enable you to accurately determine the cell viability. Cell viability is calculated as the number of viable cells divided by the total number of cells within the grids on the hemacytometer. If cells take up trypan blue, they are considered non-viable.
1. Determine the cell density of your cell line suspension using a hemacytometer.
2. Prepare a 0.4% solution of trypan blue in buffered isotonic salt solution, pH 7.2 to 7.3 (i.e., phosphate-buffered saline).
3. Add 0.1 mL of trypan blue stock solution to 1 mL of cells.
4. Load a hemacytometer and examine immediately under a microscope at low magnification.
5. Count the number of blue staining cells and the number of total cells.

% viable cells=[1.00−(Number of blue cells÷Number of total cells)]×100

To calculate the number of viable cells per mL of culture, use the following formula:

Number of viable cells×$10^4$×1.1=cells/mL culture
(Remember to correct for the dilution factor).

3.2 Results

Figure 13:
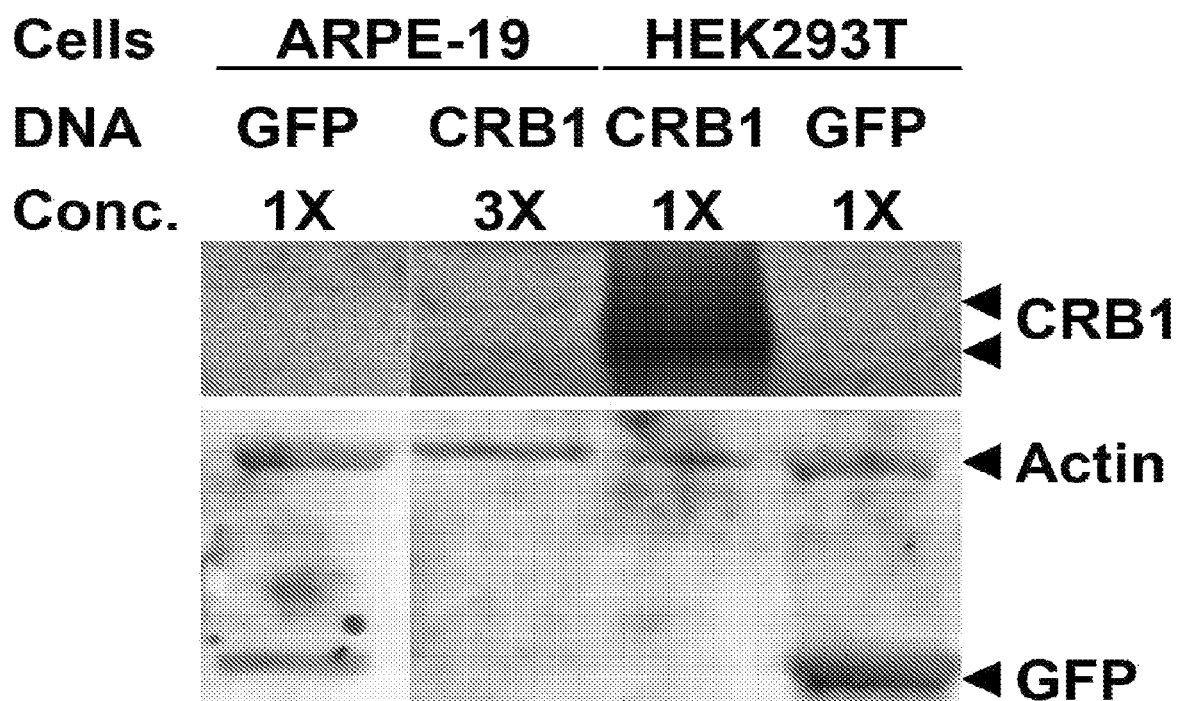
FIG. 13. GFP and CRB1 protein expression in cell lines. Western Blotting of HEK293T cell lysates transfected with the calcium phosphate method and 10 μg of pAAV-CMV-GFP-WPRE-pA or pAAV-CMV-hCRB1-pA vectors showed subsequent CRB1 and GFP protein levels. However, whereas RPE-derived ARPE-19 cells expressed normal amount of GFP, CRB1 protein is just above detection level in three times overloaded protein lysates.
Figure 14A:
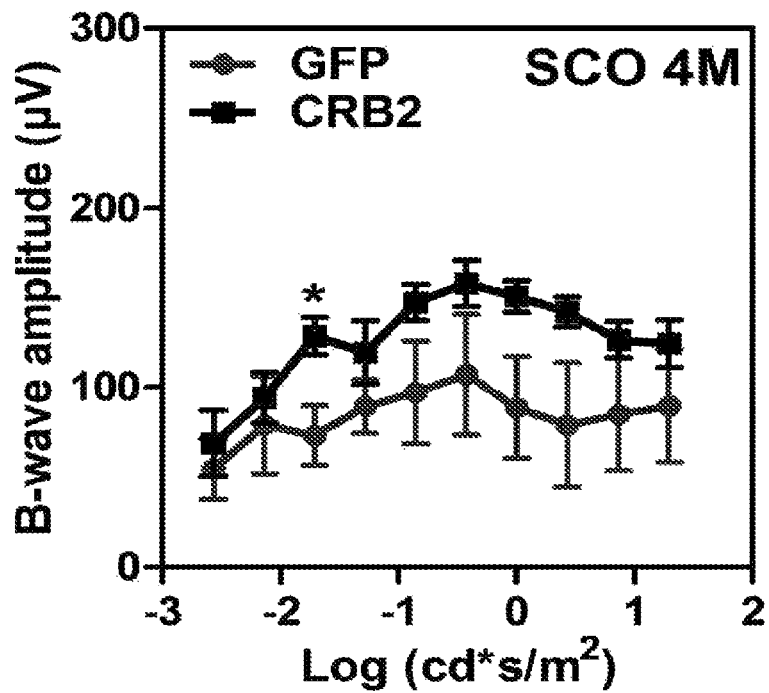
FIG. 14. Rescue of loss of retinal function by subretinal injection of AAV2/9-CRB2 viral particles in Crb mutant mouse eyes; failure of rescue of retinal function by AAV2/9-CRB1 viral particles. $Crb1^{-/-}Crb2^{F/+}$ $Chx10Cre^{Tg/+}$ ($Crb1Crb2^{F/+}$ cKO; a-f) and $Crb2^{F/F}$ $Chx10Cre^{Tg/+}$ (Crb2 cKO; g-h) mouse retinas injected subretinally at 2 weeks of age with 1 μL of $2\cdot10^{10}$ genome copies of 4.9 kb AAV2/9-CMV-CRB2-In5-spA (briefly AAV2/9-CRB2), i.e. CRB2 flanked by AAV2 ITRs and packaged in AAV9 capsid proteins and in the contralateral control eye with AAV2/9-CMV-GFP (a-c, g-h), or with 1 μl of $1\times10^{10}$ genome copies of 4.8 kb AAV2-minimalCMV-CRB1-spA (minimal CMV presented as SEQ ID NO: 133 in the Sequence listing) containing AAV9 viral particles and in the contralateral control eye with AAV2/9-minCMV-GFP (d-f), and analyzed at 3 or 4 months of age by electroretinography under scotopic (dark-adapted; a-b, d-e, g-h) or photopic (light-adapted; c, f) conditions. Scotopic b-wave amplitudes (a, d, g) and a-wave amplitudes (b, e, h), and photopic b-wave amplitudes (c, f) are indicated. CRB2 vectors rescued loss of retinal function in two different Crb mutant mouse models (a-c, g-h), whereas CRB1 vectors did not rescue loss of retinal function (d-f).
Figure 14B:
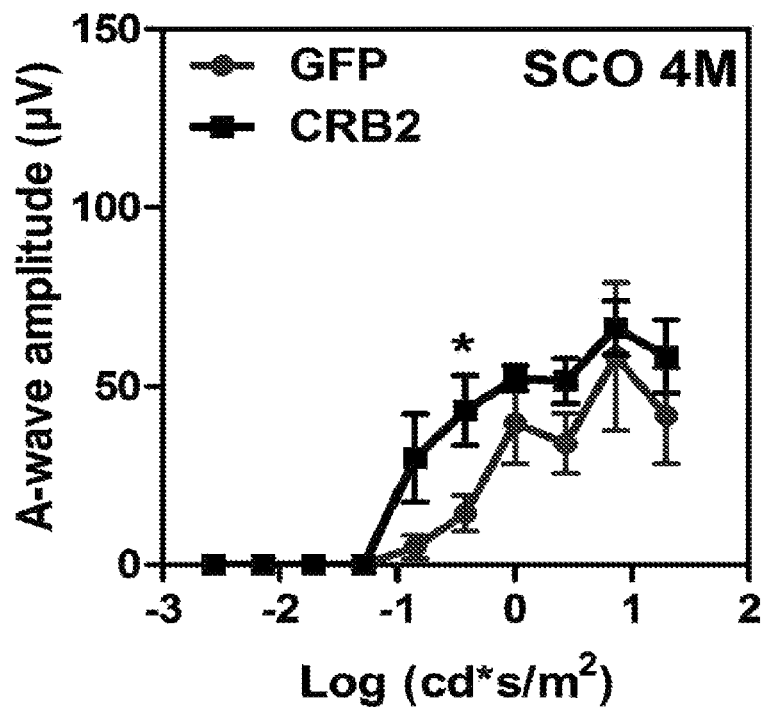
Figure 14C:
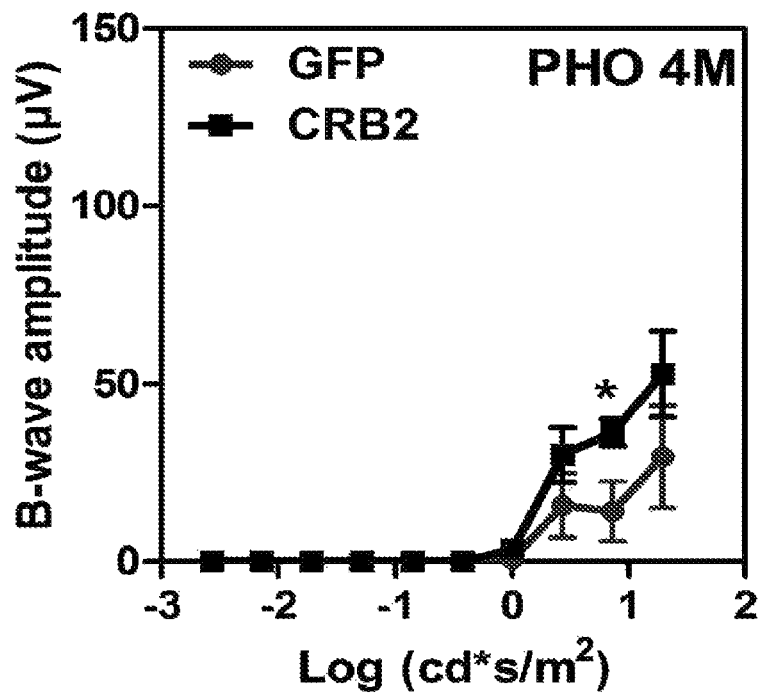
Figure 14D:
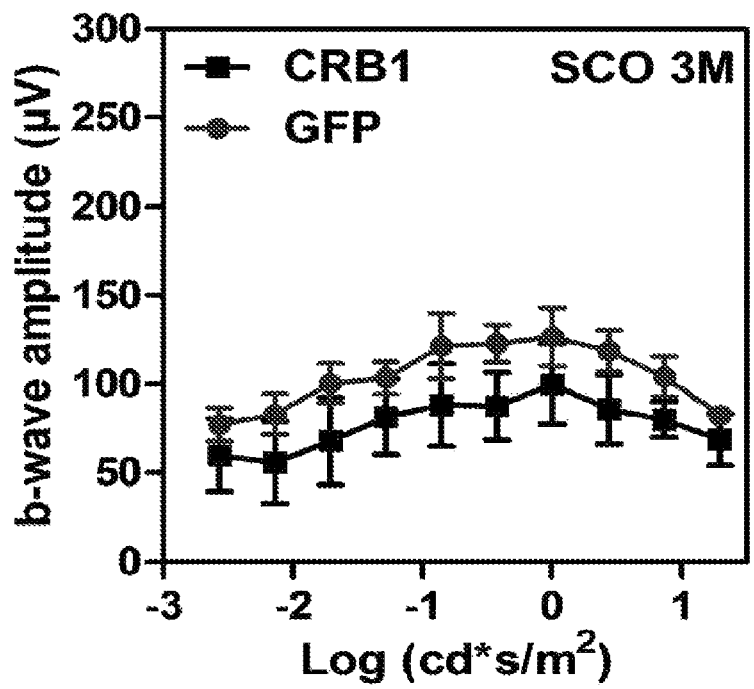
Figure 14E:
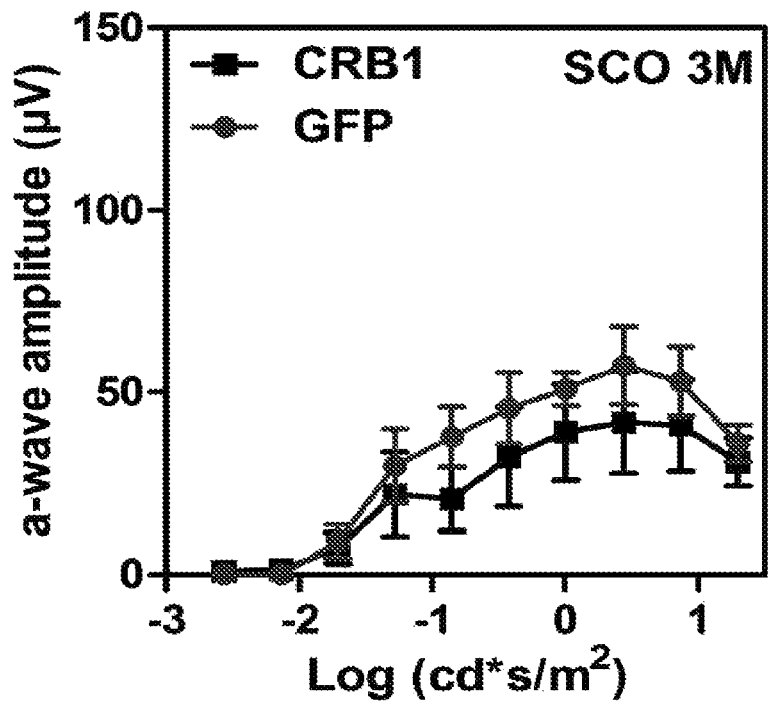
Figure 14F:
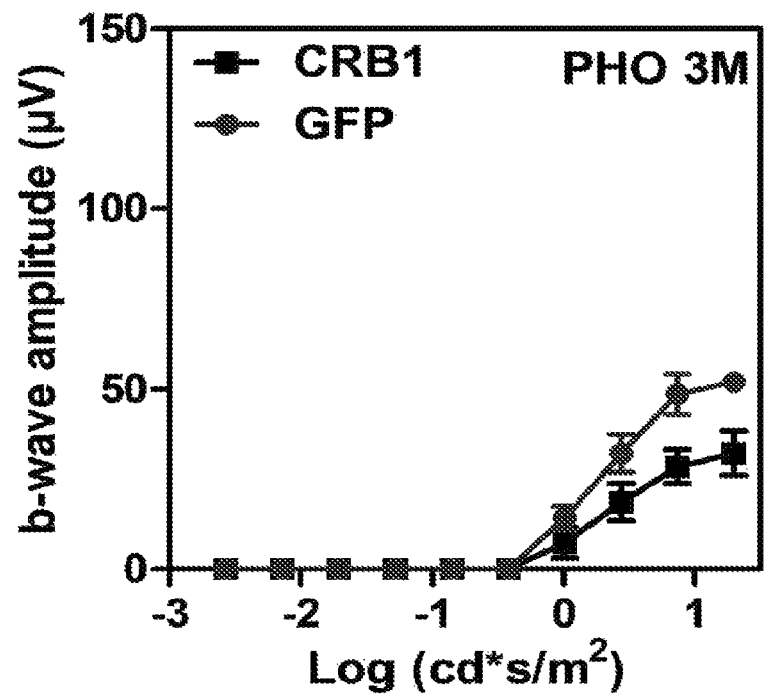
Figure 14G:
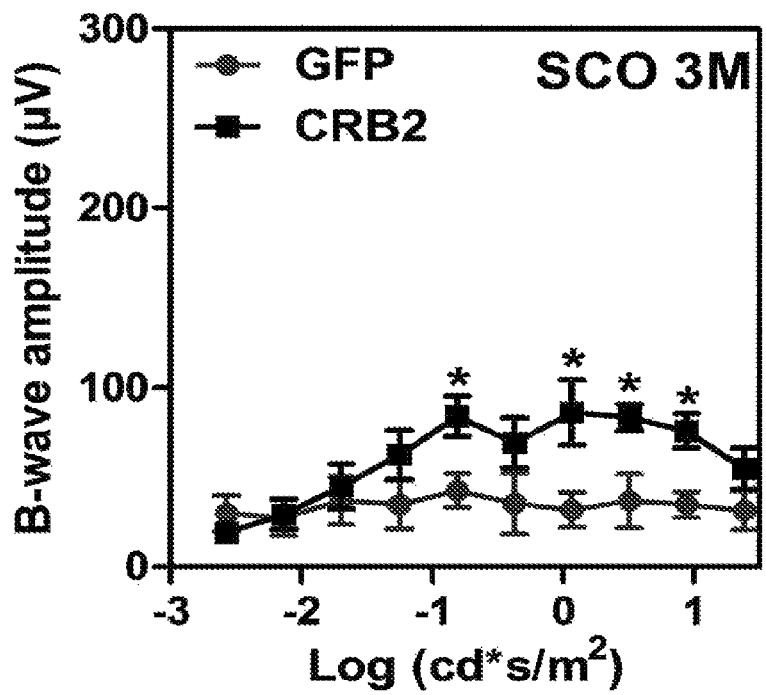
Figure 14H:
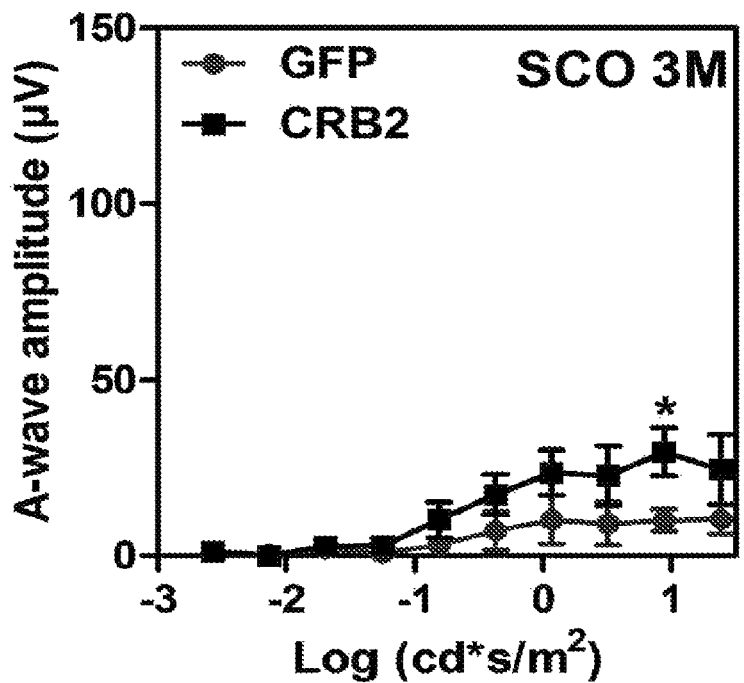
Figure 15A:
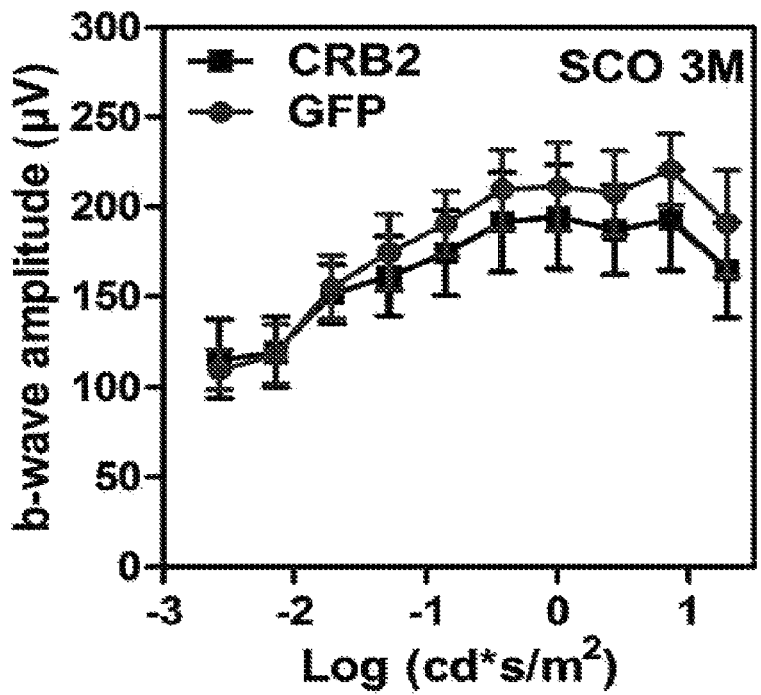
FIG. 15. Toxicity of CRB proteins tested by intravitreal injection of AAV2/ShH10Y-minimalCMV-CRB1-In5-spA or AAV2/ShH10Y-CMV-CRB2-In5-spA viral particles in Crb mutant mouse eyes, i.e. CRB2 or CRB1 DNA operably linked to the promoter that is indicated, flanked by AAV2 ITRs and packaged in ShH10Y capsid proteins. $Crb1^{-/-}$ $Crb2^{F/+}$ $Chx10Cre^{Tg/+}$ ($Crb1Crb2^{F/+}$ cKO; a-e) mouse retinas injected intravitreally at 2 weeks of age with 1 μL of $10^{10}$ genome copies of 4.9 kb AAV2/ShH10Y-CMV-CRB2-In5-spA and in the contralateral control eye with AAV2/ShH10Y-CMV-GFP (a-b), or with 1 μL of $5\cdot10^9$ genome copies 4.8 kb AAV2/ShH10Y-minimalCMV-CRB1-In5-spA containing ShH10Y viral particles and in the contralateral control eye with AAV2/ShH10Y-minimalCMV-GFP (c-e). The eyes were analyzed at 3 months of age by electroretinography under scotopic (dark-adapted; a-b, c-d) or photopic (light-adapted; e) conditions. Scotopic b-wave amplitudes (a, c) and a-wave amplitudes (b, d), and photopic b-wave amplitudes (e) are indicated. No statistical significant differences in retinal function were detected for intravitreally applied CRB2 vectors compared to GFP control vectors (a-b). Intravitreally applied CRB1 vectors showed strongly reduced retinal responses upon expression of CRB1 vectors, suggesting toxic effects by CRB1 vectors.
Figure 15B:
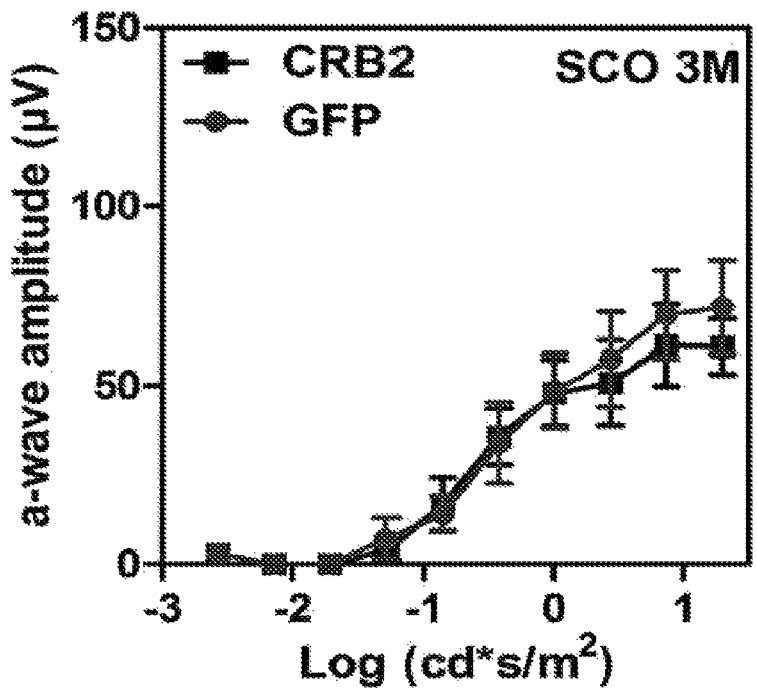
Figure 15C:
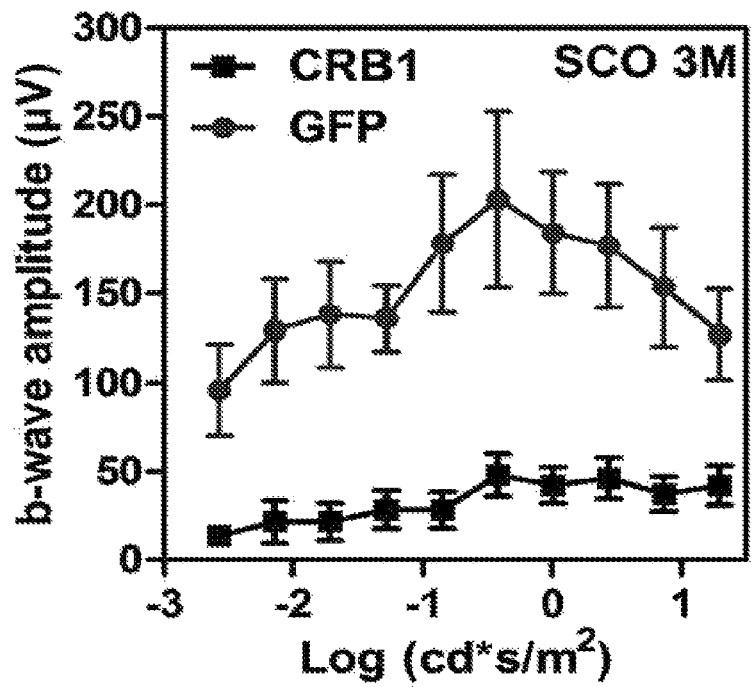
Figure 15D:
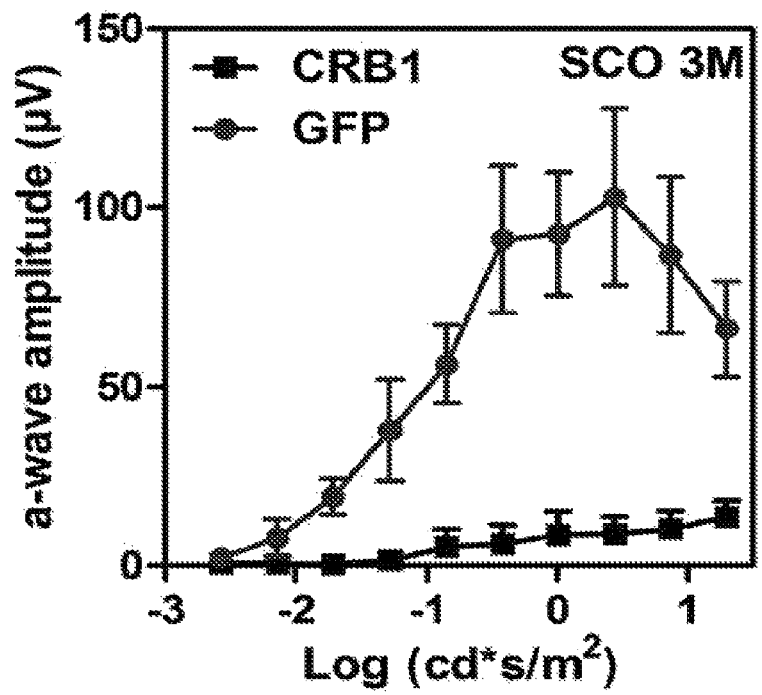
Figure 15E:
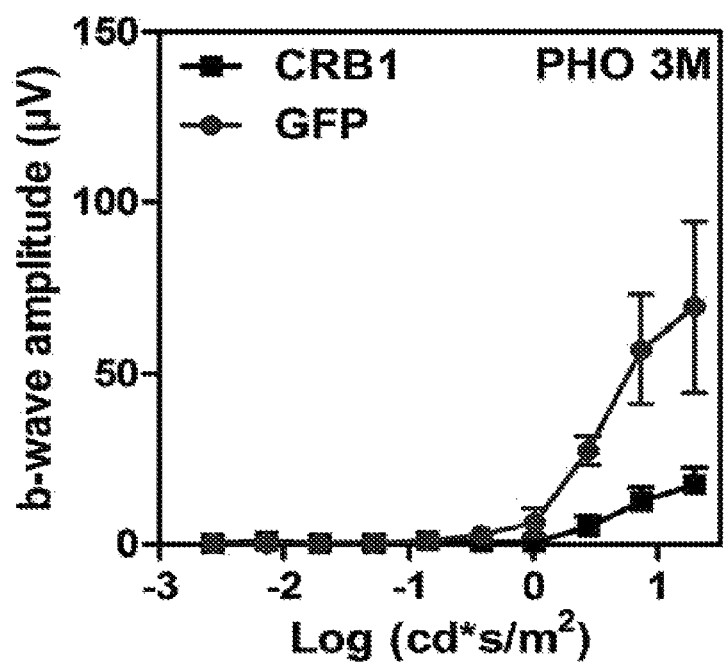

Transfection of full length CRB1 in ARPE-19 cells lead to high number of detached/dead cells and resulted in less than 20% viable CRB1 transfected cells. Transfection of CRB2 in ARPE-19 cells resulted in more than 95% viable transfected cells. This indicates that full length CRB1 is toxic and/or inhibits cell growth. The amount of CRB1 expressed in the attached cells is almost undetectable by Western Blot in contrast to GFP in ARPE-19 or CRB1 in HEK293T cells (FIG. 13). Furthermore, even overloaded three times, the reference protein level (Actin) in CRB1-transfected ARPE-19 is still lower than GFP-transfected ARPE-19. This demonstrates that full length CRB1 is toxic and/or inhibits cell growth.

For further analysing the toxicity effects by full length CRB1 compared to CRB2, we use the following constructs: AAV-truncatedCMV-CRB1; AAV-hGRK1-CRB1; AAV-hGRK1-sCRB1; AAV-hRHO-sCRB1.

Example 4

Gene Replacement Therapy in Crb1(−/−) Crb2(flox/+)Chx10Cre and Crb2(flox/flox)Chx10Cre Mice Using AAV2/9-CMV-CRB2-In5

The Crb1Crb2$^{flox/+}$ conditional knock-out mouse lacking CRB1 in all retinal cells and with reduced levels of CRB2 in all retinal cells except the retinal pigment epithelium (e.g. the Crb1$^{−/−}$Crb2$^{flox/+}$Chx10Cre on 75% C57BL/6J and 25% 129/Ola genetic background) and Crb2 cKO mice (99.9% C57BL/6J background) were used to evaluate gene replacement therapy using AAV2/9-CMV-CRB2-In5. The Crb1$^{−/−}$Crb2$^{flox/+}$Chx10Cre mice on 75% C57BL/6J and 25% 129/Ola genetic background exhibit progressive retinal degeneration and scotopic (rod-mediated) and photopic (cone-mediated) loss of retina function as measured by ERG from 3 to 6 months of age (Pellissier L. P. (2014) CRB2 acts as a modifying factor of CRB1-related retinal dystrophies in mice. *Hum Mol Genet.* July 15; 23(14):3759-71). The mouse is blind at 12-18 months of age.

AAV-mediated transfer of CRB2 using AAV2/9-CMV-hCRB2-In5 to Crb1Crb2$^{flox/+}$ cKO retina restored vision to these animals as evidenced by ERG. AAV-mediated transfer of CRB2 to the postnatal Crb1Crb2$^{flox/+}$ cKO retina expressed CRB2 in photoreceptors and Müller glia cells and caused preservation of retinal structure at the time of expression of CRB2.

Subretinal AAV-mediated transfer of CRB2 using 1 µL of 2·$10^{10}$ genome copies of AAV9 viral particles containing 4.9 kb AAV2-CMV-hCRB2-In5 to Crb1Crb2$^{flox/+}$ cKO retina or Crb2 cKO retina restored vision to these animals as evidenced by ERG, FIG. 14 (*a-c, g-h*). Subretinal AAV9-mediated transfer of CRB2 to the postnatal Crb1Crb2$^{flox/+}$ cKO retina or Crb2 cKO retina expressed CRB2 in photoreceptors and Müller glia cells and caused preservation of retinal structure at the time of expression of CRB2.

These experiments showed the feasibility of preserving retinal structure after a single dose of AAV2/9-CMV-hCRB2-In5 (in short AAV-CRB2) even in severely degenerating Crb1Crb2$^{flox/+}$ cKO or Crb2 cKO retinas. These data demonstrate that loss of CRB1 in the Crb1$^{−/−}$Crb2$^{flox/+}$ Chx10$^{Cre}$ retinas can be compensated by rescue using AAV-CRB2. In other words, these data demonstrate that elevating levels of CRB2 by using AAV-CRB2 in the Crb1$^{−/−}$Crb2$^{flox/+}$Chx10Cre retinas can rescue the degeneration phenotype in retinas lacking CRB1 and having reduced levels of CRB2.

Example 5

Lack of Gene Replacement Therapy in Crb1(−/−)Crb2(flox/+)Chx10Cre Using AAV2/9-CMV-CRB1

Subretinal AAV-mediated transfer of CRB1 using 1 µL of $10^{10}$ genome copies of AAV9 viral particles containing 4.8 kb AAV2-minimalCMV-hCRB1 expression vector (i.e., hCRB1 operably linked to the minimalCMV promoter and flanked by AAV2 ITRs, packaged in AAV9 capsid proteins) to Crb1Crb2$^{flox/+}$ cKO retina (99.9% C57BL/6J background) did not restore vision to these animals as evidenced by ERG, FIG. 14 (*d-f*). As evidenced by immunohistochemistry experiments, subretinal AAV-mediated transfer of CRB1 to the postnatal Crb1Crb2$^{flox/+}$ cKO retina expressed CRB1 in photoreceptors and Müller glia cells but did not cause preservation of retinal structure at the time of expression of CRB1 (data not shown). These experiments showed the lack of capacity of wild type CRB1 in preserving retinal structure after a single dose of AAV-CRB1 in severely degenerating Crb1Crb2$^{flox/+}$ cKO retinas. Example 4 showed that wild type CRB2 can work as a gene replacement therapy, whereas example 5 demonstrated that wild type CRB1 in the Crb1$^{−/−}$Crb2$^{flox/+}$Chx10Cre retinas cannot.

Example 6

Toxicity Test of CRB Proteins in Crb1(−/−)Crb2(flox/+)Chx10Cre Mice

Toxicity of CRB proteins can be tested using Crb1(−/−)Crb2(flox/+)Chx10Cre mice according to the following Example.
6.1. Materials and Methods
Crb1(−/−)Crb2(flox/+)Chx10Cre mouse retinas are intravitreally injected with a (modified) CRB construct (e.g. CRB1, short CRB1, CRB2 isoform 1, CRB2 isoform 2, CRB2 isoform 3, CRB3 etc.) in a recombinant AAV expression vector in one eye, whereas the contralateral eye receives a control AAV-GFP construct (Aartsen et al. (2010) PLoS One 5:e12387; GFAP-driven transgene expression in activated Müller glial cells following intravitreal injection of AAV2/6 vectors; UniProtKB/Swiss-Prot sequence P42212). The eyes are treated with the vectors using the AAV transduction method (described e.g. in Aartsen et al. (2010) PLoS One 5:e12387; GFAP-driven transgene expression in activated Müller glial cells following intravitreal injection of AAV2/6 vectors). Control animals receive a AAV-CRB2 construct in one eye and the control AAV-GFP construct in the contralateral eye (CRB2 sequence: SEQ ID NO:40). The AAV-CRB constructs are intravitreally injected into the eyes of Crb1(−/−)Crb2(flox/+)Chx10Cre mice in equimolar amounts and a total amount of 1 μL of $5·10^9$ to $10^{10}$ genome copies of AAV2/ShH10Y-(CMV or minimalCMV)-CRB and in the contralateral control eye with the same amount of AAV2/ShH10Y-(CMV or minimalCMV)-GFP. AAV-CRB constructs are made as described in Example 2.1. Briefly, CRB constructs are made by chemical synthesis and subcloned into pUC57. These constructs comprise AAV2 ITRs (SEQ ID NO:131 and 132), CMV promoter (SEQ ID NO:121) or minimal CMV promoter, CRB cDNA to be tested (e.g. SEQ ID NO:40 or other CRB sequence, synthetic pA (SEQ ID NO:130) and an optional Intron 5 (SEQ ID NO: 128). The GFP construct is used as internal transduction control in a fixed amount. Plasmids are packaged in AAV serotype ShH10Y capsids. Intravitreal ShH10Y-mediated transfer of genes to the mouse retina expressed proteins in Müller glia cells and other inner retinal cell types (Pellissier et al., (2014) Molecular Therapy Methods & Clinical Development 1:14009; Specific tools for targeting and expression in Müller glial cells) as well as the retinal ciliary body.

Three to seven $Crb1^{-/-}Crb2^{F/+}$ $Chx10Cre^{Tg/+}$ ($Crb1Crb2^{F/+}$ cKO) are injected at 2 weeks of age intravitreally with 1 μL of $5·10^9$ to $10^{10}$ genome copies of CRB or control GFP viral particles. In vivo retinal function is to be analyzed at 3 to 5 months of age by electroretinography under scotopic (dark-adapted overnight) or photopic (light-adapted with a background illumination of 30 cd/m2 starting 10 minutes before recording) conditions. Mice are anaesthetized using ketamine (66.7 mg/kg body weight) and xylazine (11.7 mg/kg body weight). The pupils are dilated and single royal blue-flash stimuli range from −3 to 1.5 log cd s/m2. Twenty responses are averaged with interstimulus intervals of 2 s. A-wave responses revealed direct photoreceptor functions (rods and cones under scotopic and only from cones under photopic conditions) and B-waves revealed the retinal activities. A representative experiment is shown in FIG. 15.

Potential toxicity (represented by a decreased retinal activity as determined by ERG) of CRB proteins is measured in comparison to GFP contralateral eyes. Significant reduction of the ERG average responses will be considered as toxicity. An example is shown in FIG. 15, CRB1 protein showed signs of toxicity whereas CRB2 does not.

Retinal expression of CRB proteins upon intravitreal transduction in $Crb1Crb2^{F/+}$ cKO or Crb2 cKO eyes is examined by standard immunohistochemistry using antibodies against the respective CRB proteins (e.g. anti-CRB2 or anti-CRB1 or anti-CRB3 as in van de Pavert et al., J. Cell Science, 2004).

6.2 Results

Intravitreal transduction of full length CRB1 into $Crb1Crb2^{F/+}$ cKO eyes lead to a significant reduced b-wave and a-wave in electroretinograms. Similar experiments using full length CRB2 do not show decreases in b-waves of a-waves. This indicates that full length CRB1 is toxic (reduces the a- and/or b-waves in electroretinograms) to the $Crb1Crb2^{F/+}$ cKO retina when applied intravitreally using 1 μL of $5·10^9$ to $10^{10}$ genome copies of capsid ShH10Y particles, whereas CRB2 is not toxic.

REFERENCES

The following references, to the extent that they provide exemplary procedural or other details supplementary to those set forth herein, are specifically incorporated herein by reference.

International Publication Number WO 2011/133933 and references to patents mentioned herein.
Aartsen, W. M. (2010). *PLoS One* 5, e12387.
Acland, G. M. (2005). *Mol Ther* 12, 1072-1082.
Acland, G. M. (2001). *Nat Genet* 28, 92-95.
Aleman, T. S. (2011). *Invest Ophthalmol Vis Sci* 52, 6898-6910.
Alexander, J. J. (2007). *Nat Med* 13, 685-687.
Allocca, M. (2007). *J Virol* 81, 11372-11380.
Alves, C. H. (2013). *Hum Mol Genet* 22, 35-50.
Alves C. H. (2014) *Hum Mol Genet.* 2014 Jul. 1; 23(13): 3384-401.
Amado, D. (2010). *Sci Transl Med* 2, 21ra16.
Annear, M. J. (2011). *Gene Ther* 18, 53-61.
Ashtari, M. (2011). *J Clin Invest* 121, 2160-2168.
Bainbridge, J. W. (2009). *Eye (Loud)* 23, 1898-1903.
Bainbridge, J. W. (2008). *N Engl J Med* 358, 2231-2239.
Bainbridge, J. W. (2009). *J Gene Med* 11, 486-497.
Bazellieres, E. (2009). *Front Biosci* 14, 2149-2169.
Beltran, W. A. (2010). *Gene Ther* 17, 1162-1174.
Bennett, J. (2012). *Sci Transl Med* 4, 120ra15.
Bennicelli, J. (2008). *Mol Ther* 16, 458-465.
Bianchi, S. (2010). *J Neurol* 257, 1039-1042.
Blits, B. (2010). *J Neurosci Methods* 185, 257-263.
Booij, J. C. (2005). *J Med Genet* 42, e67.
Boutin, S. (2010). *Hum Gene Ther* 21, 704-712.
Boye, S. E. (2012). *Hum Gene Ther* 23, 1101-1115.
Boye, S. E. (2013a). *Mol Ther.*
Boye, S. E. (2010). *PLoS One* 5, e11306.
Boye, S. L. (2011). *Invest Ophthalmol Vis Sci* 52, 7098-7108.
Boye, S. L. (2013b). *Hum Gene Ther* 24, 189-202.
Buch, P. K. (2008). *Gene Ther* 15, 849-857.
Bujakowska, K. (2012). *Hum Mutat* 33, 306-315.
Bulgakova, N. A. (2009). *J Cell Sci* 122, 2587-2596.
Chung, D. C. (2009). *JAAPOS* 13, 587-592.
Cideciyan, A. V. (2010). *Prog Retin Eye Res* 29, 398-427.
Cideciyan, A. V. (2008). *Proc Natl Acad Sci USA* 105, 15112-15117.
Cideciyan, A. V. (2009). *Hum Gene Ther* 20, 999-1004.
Cideciyan, A. V. (2013). *Proc Natl Acad Sci USA* 110, E517-E525.
Corton, M. (2013). *Orphanet J Rare Dis* 8, 20.
Cremers, F. P. (2004). *Novartis Found Symp* 255, 68-79.
Cremers, F. P. (2002). *Hum Mol Genet* 11, 1169-1176.
Dalkara, D. (2009). *Mol Ther* 17, 2096-2102.
Dalkara, D. (2011). *Mol Ther* 19, 1602-1608.
Davis, J. A. (2007). *J Blot Chem* 282, 28807-28814.
den Hollander, A. I. (2010). *J Clin Invest* 120, 3042-3053.
den Hollander, A. I. (2004). *Hum Mutat* 24, 355-369.
den Hollander, A. I. (2002). *Mech Dev* 110, 203-207.
den Hollander, A. I. (2001a). *Am J Hum Genet* 69, 198-203.
den Hollander, A. I. (2001b). *Hum Mol Genet* 10, 2767-2773.

den Hollander, A. I. (2007). *Invest Ophthalmol Vis Sci* 48, 5690-5698.
den Hollander, A. I. (2008). *Prog Retin Eye Res* 27, 391-419.
den Hollander, A. I. (1999). *Nat Genet* 23, 217-221.
Drack, A. V. (2009). *JAAPOS* 13, 463-465.
Dong, B. (2010). *Mol Ther* 18, 87-92.
Fischer, M. D. (2009). *PLoS One* 4, e7507.
Galvin, J. A. (2005). *Ophthalmology* 112, 349-356.
Gao, G. (2011). *Hum Gene Ther* 22, 979-984.
Gerber, S. (2002). *Ophthalmic Genet* 23, 225-235.
Gillespie, F. D. (1966). *Am J Ophthalmol* 61, 874-880.
Glushakova, L. G. (2006) *Mol Vis* 12, 298-309.
Gosens, I. (2008). *Exp Eye Res* 86, 713-726.
Hanein, S. (2004). *Hum Mutat* 23, 306-317.
Hanein, S. (2006). *Adv Exp Med Blot* 572, 15-20.
Hauswirth, W. W. (2008). *Hum Gene Ther* 19, 979-990.
Heckenlively, J. R. (1982). *Br J Ophthalmol* 66, 26-30.
Heilbronn, R. (2010). *Handb Exp Pharmacol,* 143-170.
Henderson, R. H. (2011). *Br J Ophthalmol* 95, 811-817.
Hermens, W. T. (1999). *Hum Gene Ther* 10, 1885-1891.
Hirsch, M. L. (2010). *Mol Ther* 18, 6-8.
Hsu, Y. C. (2010). *BMC Cell Biol* 11, 60.
Izaddoost, S. (2002). *Nature* 416, 178-183.
Jacobson, S. G. (2006a). *Mol Ther* 13, 1074-1084.
Jacobson, S. G. (2006b). *Hum Gene Ther* 17, 845-858.
Jacobson, S. G. (2003). *Hum Mol Genet* 12, 1073-1078.
Jacobson, S. G. (2008). *Invest Ophthalmol Vis Sci* 49, 4573-4577.
Jacobson, S. G. (2012). *Arch Ophthalmol* 130, 9-24.
Kantardzhieva, A. (2005). *Invest Ophthalmol Vis Sci* 46, 2192-2201.
Karali, M. (2011). *PLoS One* 6, e22166.
Khani, S. C. (2007). *Invest Ophthalmol Vis Sci* 48, 3954-3961.
Klimczak, R. R. (2009). *PLoS One* 4, e7467.
Koenekoop, R. K. (2004). *Sury Ophthalmol* 49, 379-398.
Kolstad, K. D. (2010). *Hum Gene Ther* 21, 571-578.
Komaromy, A. M. (2010). *Hum Mol Genet* 19, 2581-2593.
Lai, Y. (2010). *Mol Ther* 18, 75-79.
Lambert, S. R. (1993). *Am J Med Genet* 46, 275-277.
Leber, T., (1871) *Albrecht von Graefes Arch. Ophthal.,* 17:314-340.
Leber, T., (1869) *Albrecht von Graefes Arch. Ophthal.* 15: 1-25.
Lemmers, C. (2004). *Mol Biol Cell* 15, 1324-1333.
Levitt, N. (1989). *Genes Dev* 3, 1019-1025.
Li, W. (2009). *Mol Vis* 15, 267-275.
Li, W. (2011a). *Virology* 417, 327-333.
Li, X. (2011b). *Invest Ophthalmol Vis Sci* 52, 7-15.
Livak, K. J. (2001). *Methods* 25, 402-408.
Lotery, A. J. (2001a). *Arch Ophthalmol* 119, 415-420.
Lotery, A. J. (2001b). *Ophthalmic Genet* 22, 163-169.
Lotery, A. J. (2003). *Hum Gene Ther* 14, 1663-1671.
Maguire, A. M. (2009). *Lancet* 374, 1597-1605.
Maguire, A. M. (2008). *N Engl J Med* 358, 2240-2248.
Mancuso, K. (2009). *Nature* 461, 784-787.
McKay, G. J. (2005). *Invest Ophthalmol Vis Sci* 46, 322-328.
Mehalow, A. K. (2003). *Hum Mol Genet* 12, 2179-2189.
Moore, A. T. (1984). *Br J Ophthalmol* 68, 421-431.
Mowat, F. M. (2012). *Gene Ther.*
Mussolino, C. (2011). *Gene Ther* 18, 637-645.
Omori, Y. (2006). *Curr Blot* 16, 945-957.
Pang, J. (2010). *Gene Ther* 17, 815-826.
Pang, J. J. (2006). *Mol Ther* 13, 565-572.
Pang, J. J. (2011). *Mol Ther* 19, 234-242.
Park, B. (2011). *J Neurosci* 31, 17230-17241.
Park, T. K. (2009). *Gene Ther* 16, 916-926.
Pasadhika, S. (2010). *Invest Ophthalmol Vis Sci* 51, 2608-2614.
Pawlyk, B. S. (2010). *Hum Gene Ther* 21, 993-1004.
Pawlyk, B. S. (2005). *Invest Ophthalmol Vis Sci* 46, 3039-3045.
Pellissier L. P. (2013) Targeted ablation of CRB1 and CRB2 in retinal progenitor cells mimics Leber congenital amaurosis. *PLoS Genet.* 2013 December; 9(12):e1003976.
Pellissier L. P. (2014) CRB2 acts as a modifying factor of CRB1-related retinal dystrophies in mice. *Hum Mol Genet.* July 15; 23(14):3759-71.
Pellissier L. P. (2014) Specific tools for targeting and expression of Muller glia cells. *Mol Ther Methods & Clinical Dev* 1:14009
Pellikka, M. (2002). *Nature* 416, 143-149.
Perrault, I. (1999). *Mol Genet Metab* 68, 200-208.
Petersen-Jones, S. M. (2012). *Vet Ophthalmol* 15 Suppl 2, 29-34.
Petit, L. (2012). *Mol Ther* 20, 2019-2030.
Provost, N. (2005). *Mol Ther* 11, 275-283.
Rapti, K. (2012). *Mol Ther* 20, 73-83.
Richard, M. (2006). *Hum Mol Genet* 15 Spec No 2, R235-R243.
Roh, M. H. (2002). *J Cell Biol* 157, 161-172.
Rolling, F. (2006). *Bull Mem Acad R Med Belg* 161, 497-508.
Salegio, E. A. (2012). *Gene Ther.*
Schappert-Kimmijser, J. (1959). *AMA Arch Ophthalmol* 61, 211-218.
Schroeder, R. (1987). *Arch Ophthalmol* 105, 356-359.
Schuil, J. (1998). *Neuropediatrics* 29, 294-297.
Simonelli, F. (2010). *Mol Ther* 18, 643-650.
Simonelli, F. (2007). *Invest Ophthalmol Vis Sci* 48, 4284-4290.
Stieger, K. (2008). *Mol Ther* 16, 916-923.
Stieger, K. (2011). *Methods Mol Biol* 807, 179-218.
Stieger, K. (2010). *Discov Med* 10, 425-433.
Stieger, K. (2009). *Mol Ther* 17, 516-523.
Sun, X. (2010). *Gene Ther* 17, 117-131.
Sundaram, V. (2012). *Eur J Pediatr* 171, 757-765.
Surace, E. M. (2008). *Vision Res* 48, 353-359.
Tan, M. H. (2009). *Hum Mol Genet* 18, 2099-2114.
Tanimoto N, Sothilingam V, Seeliger M W; Functional phenotyping of mouse models with ERG. Methods Mol Biol. 2013; 935:69-78
Timmers, A. M. (2001). *Mot Vis* 7, 131-137.
Vallespin, E. (2007). *Invest Ophthalmol Vis Sci* 48, 5653-5661.
van de Pavert, S. A. (2004) *J Cell Sci* 117, 4169-4177.
van de Pavert, S. A. (2007a). *J Neurosci* 27, 564-573.
van de Pavert, S. A. (2007b). *Glia* 55, 1486-1497.
van den Hurk, J. A. (2005). *Mot Vis* 11, 263-273.
van Rossum, A. G. (2006). *Hum Mol Genet* 15, 2659-2672.
van, Soest. S. (1996). *Cytogenet Cell Genet* 73, 81-85.
van, Soest. S. (1994). *Genomics* 22, 499-504.
Vazquez-Chona, F. R. (2009). *Invest Ophthalmol Vis Sci* 50, 3996-4003.
Vogel, J. S. (2007). *Invest Ophthalmol Vis Sci* 48, 3872-3877.
Waardenburg, P. J. (1963). *Acta Ophthalmol (Copenh)* 41, 317-320.
Wagner, R. S. (1985). *Arch Ophthalmol* 103, 1507-1509.
Walia, S. (2010). *Ophthalmology* 117, 1190-1198.
Wu, Z. (2010). *Mol Ther* 18, 80-86.
Yang, G. S. (2002). *J Virol* 76, 7651-7660.
Yin, L. (2011). *Invest Ophthalmol Vis Sci* 52, 2775-2783.
Yzer, S. (2006). *Invest Ophthalmol Vis Sci* 47, 3736-3744.
Zernant, J. (2005). *Invest Ophthalmol Vis Sci* 46, 3052-3059.
Zhong, L. (2008a). *Virology* 381, 194-202.
Zhong, L. (2008b). *Proc Natl Acad Sci USA* 105, 7827-7832.
Zolotukhin, S. (1999). *Gene Ther* 6, 973-985.
Zolotukhin, S. (2002). *Methods* 28, 158-167.

SEQUENCE LISTING (133 sequences)

SEQ ID NO: 1 - protein, 1406 aa, Homo sapiens
  MISC_FEATURE: Homo sapiens CRB1 isoform 1
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 2 - protein, 1376 aa, Homo sapiens
  MISC_FEATURE: Homo sapiens CRB1 isoform 2
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDVSSLSFYVSLLFWQNLFQLLSYLILRMNDEPVVEWGEQEDY

SEQ ID NO: 3 - protein, 1294 aa, Homo sapiens
  MISC_FEATURE: Homo sapiens CRB1 isoform 3
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 4 - protein, 942 aa, Homo sapiens
  MISC_FEATURE: Homo sapiens CRB1 isoform 4
MIRNSLCQPSRCLDEYLFFNRKMFGARTHGFHILMAMLIGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEW

SEQ ID NO: 5 - protein, 870 aa, Homo sapiens
  MISC_FEATURE: Homo sapiens CRB1 isoform 5
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLRGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 6 - protein, 1405 aa, Mus musculus
  MISC_FEATURE: Mus musculus CRB1 isoform 1
MKLKRTAYLLFLYLSSSLLICIKNSFCNKNNTRCLSGPCQNNSTCKHFPQDNNCCLDTANNLDKDCEDLKDPCFSSPCQGIATCVKIPGEGNFLCQCPPGYSGLNCETATNSCGGNLCQHGGTCRKDPEHPVCICPPGYAGRFCETDHNECASSPCHNGAMCQDGINGYSCFCVPGYQGRHCDLEVDECVSDPCKNEAVCLNEIGRYTCVCPQEFSGVNCELEIDECRSQPCLHGATCQDAPGGYSCDCAPGFLGEHCELSVNECESQPCLHGGLCVDGRNSYHCDCTGSGFTGMHCESLIPLCWSKPCHNDATCEDTVDSYICHCRPGYTGALCETDINECSSNPCQFWGECVELSSEGLYGNTAGLPSSFSYVGASGYVCICQPGFTGIHCEEDVDECLLHPCLNGGTCENLPGNYACHCPFDDTSRTFYGGENCSEILLGCTHHQCLNNGKCIPHFQNGQHGFTCQCLSGYAGPLCETVTTLSFGSNGFLWVTSGSHTGIGPECNISLRFHTVQPNALLLIRGNKDVSMKLELLNGCVHLSIEVWNQLKVLLSISHNTSDGEWHFVEVTIAETLTLALVGGSCKEKCTTKSSVPVENHQSICALQDSFLGGLPMGTANNSVSVLNIYNVPSTPSFVGCLQDIRFDLNHITLENVSSGLSSNVKAGCLGKDWCESQPCQNRGRCINLWQGYQCECDRPYTGSNCLKEYVAGRFGQDDSTGYAAFSVNDNYGQNFSLSMFVRTRQPLGLLLALENSTYQYVSVWLEHGSLALQTPGSPKFMVNFFLSDGNVHLISLRIKPNEIELYQSSQNLGFISVPTWTIRRGDVIFIGGLPDREKTEVYGGFFKGCVQDVRLNSQTLEFFPNSTNNAYDDPILVNVTQGCPGDNTCKSNPCHNGGVCHSLWDDFSCSCPTNTAGRACEQVQWCQLSPCPPTAECQLLPQGFECIANAVFSGLSREILFRSNGNITRELTNITFAFRTHDTNVMILHAEKEPEFLNISIQDARLFFQLRSGNSFYTLHLMGSQLVNDGTWHQVTFSMIDPVAQTSRWQMEVNDQTPFVISEVATGSLNFLKDNTDIYVGDQSVDNPKGLQGCLSTIEIGGIYLSYFENLHGFPGKPQEEQFLKVSTNMVLTGCLPSNACHSSPCLHGGNCEDSYSSYRCACLSGWSGTHCEINIDECFSSPCIHGNCSDGVAAYHCRCEPGYTGVNCEVDVDNCKSHQCANGATCVPEAHGYSCLCFGNFTGRFCRHSRLPSTVCGNEKRNFTCYNGGSCSMFQEDWQCMCWPGFTGEWCEEDINECASDPCINGGLCRDLVNRFLCICDVAFAGERCELDLADDRLLGIFTAVGSGTLALFFILLLAGVASLIASNKRATQGTYSPSGQEKAGPRVEMWIRMPPPALERLI

SEQ ID NO: 7 - protein, 1315 aa, Mus musculus
  MISC_FEATURE: Mus musculus CRB1 isoform 2
MKLKRTAYLLFLYLSSSLLICIKNSFCNKNNTRCLSGPCQNNSTCKHFPQDNNCCLDTANNLDKDCEDLKDPCFSSPCQGIATCVKIPGEGNFLCQCPPGYSGLNCETATNSCGGNLCQHGGTCRKDPEHPVCICPPGYAGRFCETDHNECASSPCHNGAMCQDGINGYSCFCVPGYQGRHCDLEVDECVSDPCKNEAVCLNEIGRYTCVCPQEFSGVNCELEIDECRSQPCLHGATCQDAPGGYSCDCAPGFLGEHCELSVNECESQPCLHGGLCVDGRNSYHCDCTGSGFTGMHCESLIPLCWSKPCHNDATCEDTVDSYICHCRPGIHCEEDVDECLLHPCLNGGTCENLPGNYACHCPFDDTSRTFYGGENCSEILLGCTHHQCLNNGKCIPHFQNGQHGFTCQCLSGYAGPLCETVTTLSFGSNGFLWVTSGSHTGIGPECNISLRFHTVQPNALLLIRGNKDVSMKLELLNGCVHLSIEVWNQLKVLLSISHNTSDGEWHFVEVTIAETLTLALVGGSCKEKCTTKSSVPVENHQSICALQDSFLGGLPMGTANNSVSVLNIYNVPSTPSFVGCLQDIRFDLNHITLENVSSGLSSNVKAGCLGKDWCESQPCQNRGRCINLWQGYQCECDRPYTGSNCLKEYVAGRFGQDDSTGYAAFSVNDNYGQNFSLSMFVRTRQPLGLLLALENSTYQYVSVWLEHGSLALQTPGSPKFMVNFFLSDGNVHLISLRIKPNEIELYQSSQNLGFISVPTWTIRRGDVIFIGGLPDREKTEVYGGFFKGCVQDVRLNSQTLEFFPNSTNNAYDDPILVNVTQGCPGDNTCKSNPCHNGGVCHSLWDDFSCSCPTNTAGRACEQVQWCQLSPCPPTAECQLLPQGFECIANAVFSGLSREILFRSNGNITRELTNITFAFRTHDTNVMILHAEKEPEFLNISIQDARLFFQLRSGNSFYTLHLMGSQLVNDGTWHQVTFSMIDPVAQTSRWQMEVNDQTPFVISEVATGSLNFLKDNTDIYVGDQSVDNPKGLQGCLSTIEIGGIYLSYFENLHGFPGKPQEEQFLKVSTNMVLTGCLPSNACHSSPCLHGGNCEDSYSSYRCACLSGWSGTHCEINIDECFSSPCIHGNCSDGVAAYHCRCEPGYTGVNCEVDVDNCKSHQCANGATCVPEAHGYSCLCFGNFTGRFCRHSRLPSTVCGNEKRNFTCYNGGSCSMFQEDWQCMCWPGFTGEWCEEDIEASVPPIPASMEDCAGTWSTGSYASVMWPSLGERCELDVSGLSFYVSLLLWQNLFQLLSYLVLHMNDEPVVEWGAQENY

SEQ ID NO: 8 - protein, 761 aa, Mus musculus
  MISC_FEATURE: Mus musculus CRB1 isoform 3
MKLKRTAYLLFLYLSSSLLICIKNSFCNKNNTRCLSGPCQNNSTCKHFPQDNNCCLDTANNLDKDCEDLKDPCFSSPCQGIATCVKIPGEGNFLCQCPPGYSGLNCETATNSCGGNLCQHGGTCRKDPEHPVCICPPGYAGRFCETDHNECASSPCHNGAMCQDGINGYSCFCVPGYQGRHCDLEVDECVSDPCKNEAVCLNEIGRYTCVCPQEFSGVNCELEIDECRSQPCLHGATCQDAPGGYSCDCAPGFLGEHCELSVNECESQPCLHGGLCVDGRNSYHCDCTGSGFTGMHCESLIPLCWSKPCHNDATCEDTVDSYICHCRPGYTGALCETDINECSSNPCQFWGECVELSSEGLYGNTAGLPSSFSYVGASGYVCICQPGFTGIHCEEDVDECLLHPCLNGGTCENLPGNYACHCPFDDTSRTFYGGENCSEILLGCTHHQCLNNGKCIPHFQNGQHGFTCQCLSGYAGPLCETVTTLSFGSNGFLWVTSGSHTGIGPECNISLRFHTVQPNALLLIRGNKDVSMKLELLNGCVHLSIEVWNQLKVLLSISHNTSDGEWHFVEVTIAETLTLALVGGSCKEKCTTKSSVPVENHQSICALQDSFLGGLPMGTANNSVSVLNIYNVPSTPSFVGCLQDIRFDLNHITLENVSSGLSSNVKAGCLGKDWCESQPCQNRGRCINLWQGYQCECDRPYTGSNCLKGERSGVPQSAVPLSRAISNHPGCRPLLGNIRTPQDLCWYLFTNEIKWHSHDMY

SEQ ID NO: 9 - protein, 389 aa, Mus musculus
  MISC_FEATURE: Mus musculus CRB1 isoform 4
MFGHKTQGFHILMAVLIGIHCEEDVDECLLHPCLNGGTCENLPGNYACHCPFDDTSRTFYGGENCSEILLGCTHHQCLNNGKCIPHFQNGQHGFTCQCLSGYAGPLCETVTTLSFGSNGFLWVTSGSHTGIGPECNISLRFHTVQPNALLLIRGNKDVSMKLELLNGCVHLSIEVWNQLKVLLSISHNTSDGEWHFVEVTIAETLTLALVGGSCKEKCTTKSSVPVENHQSICALQDSFLGGLPMGTANNSVSVLNIYNVPSTPSFVGCLQDIRFDLNHITLENVSSGLSSNVKAGCLGKDWCESQPCQNRGRCINLWQGYQCECDRPYTGSNCLKGERSGVPQSAVPLSRAISNHPGCRPLLGNIRTPQDLCWYLFTNEIKWHSHDMY

SEQ ID NO: 10 - protein, 1408 aa, Rattus norvegicus
  MISC_FEATURE: Rattus norvegicus CRB1 isoform 1
  misc_feature (225)..(225): Xaa can be any naturally occurring amino acid
  misc_feature (227)..(228): Xaa can be any naturally occurring amino acid
  misc_feature (230)..(230): Xaa can be any naturally occurring amino acid
  misc_feature (241)..(241): Xaa can be any naturally occurring amino acid
  misc_feature (245)..(246): Xaa can be any naturally occurring amino acid
MWKNLAEVSFALSLSLSLSLSLCVSNSFCNKNNTRCLSNSCQNNSTCKRFPQDSSCCLDTANDLDTDCEDLKDPCLSSPCQGTATCVNIPGERSFLCQCPPGYSGLTCDTATNSCGGNLCQHGGTCHKDPEHPVCICPPGYAGRFCETDHNECDSSPCHNGAVCQDRINGYSCFCVPGYQGRHCDLEVDECVSDPCMNEAVCLNEIGRYTCVCPQEYSGNNLSIXLXXGXSQICLYNGSHXDALXXDFCDSSLFLLGQGCGLNFKAIPRHTVLHCEPCFNLSENFFCDGYFKGNRGISASASVPLCFLKGCPEGLQNQDHLGDSYTTNCSAGYTGALCETDINECSSNPCQFGGECAELSSQDLYGNTAGLPSSFSYLGASGYVCICLPGFTGRHCEEDIDECLPNPCLNGGTCQNLPGNYTCHCPFDDTSRTFYGGEDCSEILLGCTHHQCLNNGKCIPHFQNGQHEFTCQCPSGYAGPLCETVTTLSFESNGFLWVTSGSHTSMGSECNISLKFQTVQPNALLLVRGNKDMSVKLELLDGCVHLSIEVWNQSKVLLYISHNTSDGEWHLVEVTFAETITLALNGSSCKEKCTTKSSVSIENHQSICALQNSFLGGLPMGTASDSMSVLNIYNVPSTPSFVGCLQDIRFDLNHITLESISSGLSSNVKAGCLRKDWCESQPCQNRGRCINLWQGYRCECDRPYAGSNCLKEYVAGRFGQDDSTGYAAFKVNDNFGQNFNLSMFVRTRQPLGFLLTLGNSTYQYVCVWLEHGSLALKTPGSPKLVANFFLSDGNAHLISLRIKPNEIELYQSSQNLGFMSVPAWTIQRGDVIFIGGLPDREKTEAYGGFLKGCIQDVRLNSQNLEFFPNSTNSAQHDPVLVNVTQGCPGDNVCKSNPCHNGGVCHSLWDDFSCSCPTNTSGRACDEVQWCQLSPCPPIAECQLVPQGFECIANAAFSGLSSEILFRSNGNITRELTNITFGFRTQDTNAVILHAEKEPEFLNISIQDSRLLFQLRSGNSFYTLHLTGSQLVNDGAWHRVTFSMIDPRAQTSLWQMEVDDQTPFVISAVATGNLNFLKDNTDIYVGDQAVDNQKGLQGCLSTVQIGGLYLSYFESLHGFTSKPQEEQFLKVSTNVALTGCLPLSACHSSPCLHGGICEDSYSSYRCACLPGWSGAHCEINVDECSSSPCVHGNCSDGVAAYHCRCEPGYTGGNCEAEVDTCKSHQCANGATCVSGAQGYSCLCLGNFTGRFCRHSRLPSTVCGNEKTNFTCYNGGSCSVFQEDWKCVCRPGFTGEWCEENINECASDPCINGGLCRDLVNRFQCICDVAFAGERCELDLADDRLVGIITAVGSGTLVLLFILLLAAIVSLIASNKRATQGTYSPSGQEKAGPRVEMWSRMPPPALERLI

SEQ ID NO: 11 - protein, 1406 aa, Spermophilus tridecemlineatus
  MISC_FEATURE: Spermophilus tridecemlineatus CRB1 isoform 1
MALKKTNHLLIFYLSFSLFIYIKNSFCNKNNTRCLSNSCQNNSACKGFSQDSNCHCSDITNNLDKDCDNMRDPCFSSPCQGSATCVNTPGKRSFQCQCPPGYSGITCEITTGSCGMNSCQHGGICHQDPVDPVCICPAGYTGRFCEIDHNDCASSPCYNGAVCQDGINGYSCFCVPGYQGRHCDLEVNECVSDPCKNGATCLNEIGRYTCICPQYYSGVNCELEIDECWSQPCLNGATCQDALGAYFCDCAPGFLGNHCELNFDECASQPCLHGGLCVDGGNRYSCNCTGSGFTGTHCETLMPLCWSKPCHHNATCEDSVDNYICHCWPGYTGAQCEMDINECESNPCQSDGECIELSSEKQYGRIAGLPSSFSYLEASGYVCICQPGFTGIHCEEDIDECSSNPCQNGGTCENLPGNYTCHCPFDNISGTFYGGENCSDILLGCTHHQCLNNGVCIPHFQNDQHGFSCLCPPGYTGSLCETVTTLSFEGNGFLWVTSGPHTTKDSVCNIAFRFQTVQPTALLLFQGNRDTFVKMELLSGYIHLSIQVHNQSKVLLYISHNTSDGEWHSVEVIFAETVTLTLASSSCTEKCIAKAPSPFERTQSICAFQNSFLGGLPVGSASNAVTLLNIYNIPSTPSFVGCLQDIKFDLNPITWENISSGLSLNVKAGCVRKDWCESQPCQNRGRCINLWLSYQCDCYRPYEGPNCLREYVAGRFGQDDSTGYAVFNLDRSYGQNFSLSMFVRTNRPSGLLLTLKNSTYQYIRVWLEHGRLALLTPSSPKFTVEFVLSDGNVHLVTLKIKPNKIELYQSSQNLGFISAATWKIQRGDVIHIGGLPDKKETEIYGGFFKGCIQDVRLNNQNLEFFPNSTNSASHSPILVNVTQGCLGDNICKTNPCHNGGICYSLWDDFSCSCPANTAGKACEEVRWCELSPCPPSAQCRLVPKGFECIANAVFNGQSSEILFRSNGNITRELTNITFGFRTKDANVKILHAEKEPEFLNISIQESRLFFQLRSGNSFYVLHLTSLQSVNDGTWHQVALSMIDPLAQASRWQMEVDHQTPFVTSAIATGNLNFLKDNTDIYVGDRALNNRKGLQGCLSTIEIGGIYLSYFENAHGFTNKPQEEQFLKISTNSVATGCLQLNACNSNPCLHGGNCEDIYSSYHCSCPLGWSGTHCELNIDECFSDPCIHGNCSDRVAAYHCRCEPGYTGVNCEMEIDNCQNHQCANGATCISETNGYSCLCFGNFTGKFCRYRRLPSTVCGNEQTNLTCYNGGNCTEFQNELKCMCRPGFTGERCEKDIDECASNPCFNGGLCQDLLDKFQCLCDVAFAGERCELDLADDLISNIFTAIGSVTLALLFILLLAVAASIIASKKRATQGTYSPCRQEKEGSRVEMWSMRQPPTLERLI

SEQ ID NO: 12 - protein, 1406 aa, Pongo abelii
  MISC_FEATURE: Pongo abelii CRB1 isoform 1
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYTGRFCEIDHDECASSPCQNGAVCQDGIDGYSCFCVPGYQGRHCDLEVDECASDPCKNEATCLNEIGRYICICPRDYSGVNCELEIDECWSQPCLNGATCQDALGAYFCDCAPGFLGDHCEFNIDECASQPCLHGGLCVDGENRYSCNCTGSGFTGTHCETLMPLCWSKPCHNNATCEDSVDNYTCHCWPGYTGAQCEIDINECNSNPCQSNGECVELSSEKQYGHITGLPSSFSYHEASGYVCICQPGFTGIHCEEDVNECFSNPCQNGGTCENLPGNYTCHCPFDNLSRTFYGGRDCSAILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLYISHDTSDGEWHFVEVIFAKAVTLTLIDDSCKEKCIAKAPSPLESDQSICAFQNSFLGGLPVGTTSNGVALLNFYNIPSTPSFVGCLQDIKIDWNHITLENISSGSSLNVKAGCVRKDWCESQPCQSRGRCINLWLSYQCDCHRPYKGPNCLREYVAGRFGQDDSTGYVVFTLDESYGDTISLSMFVRTLQPSGLLLALENSTYQYIRVWLEHGRLAMLTPKSPKLVVKFVLNDGNVHLISLKIKPNKIELYQSSQNLGFISASTWKIQKGDIIYIGGLPDKQETELNGGFFKGCIQDVRLNNQNLEFFPNPTNDASLKPVLVNVTQGCPGDNSCKSNPCHNGGVCHSLWDDFSCSCPAHTSGKACEEVQWCGFSPCPRGAQCQPVLQGFECIANAVFNGQSSQILFRSNGNITRELTNITFGFRTRDANVIILHAEKEPEFLNISIQDSRLFFQLQSGNSFYMLSLASLQSVNDGTWHEVTLSMTDPLSQTSRWQMEVDNQTPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISDTNGYSCLCFGNFTGKFCRQSRLPSTVCGNEKTNLTCYNGGNCTEFQAELKCMCRPGFTGEWCEKDIDECASDPCVNGGLCQDLLNKFQCLCDIAFAGEHCEVDLADDLISDIFTAIGSVTLALLLILLLAIVASVVTFNKRATQGTYSPSRQEKEGSRVEMWNLMPPPAMERLI

SEQ ID NO: 13 - protein, 1406 aa, Pan troglodytes
  MISC_FEATURE: Pan troglodytes CRB1 isoform 1
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDINECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGICIPHFQDGQHGFSCLCPSGYTGSLCEIATTLSFEGDGFLWVKSGSVTTKGSVCDIALRFQTVQPMALLLFRSNRDVFVKLELLSGYIHLSIQVNNQSKVLLFISHNTSDGEWHFVEVIFAEAVTLTLIDDSCKEKCIAKAPSPLESDQSICAFQNSFLGGLPVGMTSNGVALLNFYNIPSTPSFVGCLQDIKIDWNHITLENISSGSSLNVKAGCVRKDWCESQPCQSRGRCINLWLSYQCDCHRPYKGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPNKIELYQSSQNLGFISASTWKIEKGDVIYIGGLPDKQGTELNGGYFKGCIQDVRLNNQNLEFFPNPTNNASLNPVLVNVTQGCPGDNSCKSNPCHNGGVCHSWWDDFSCSCPAHTSGKACEEVQWCGFSPCPRGAQCQPVLQGFECIANAVFNGQSSQILFRSNGNITRELTNITFGFRTRDANVIILHAEKEPEFLNISIQDSRLFFQLQSGNSFYTLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQAELKCMCRPGFTGEWCEKDIDECASDPCVNGGLCQDLLNKFQCLCDVAFAGERCEVDLADDLISDIFTTIGSVTIALLLILLLAIVASVVTSNKRATQGTYSPSRQEKEGSRVEMWNLMPAPAMERLI

SEQ ID NO: 14 - protein, 1406 aa, Nomascus leucogenys
  MISC_FEATURE: Nomascus leucogenys CRB1 isoform 1
MALKNINYLLIFYLSFSLLIYIKNSFCNKNNTRCLSNSCQNNSTCKDFSKDSDCSCSDTANNFDKDCDDMKDPCFSNPCQGSATCVNTPGERSFLCKCPPGYSGTICETTIGSCGENSCQHGGICHQDPIDPVCICPAGYAGRFCEIDHDECASSPCQNGAVCQDGIDGYSCFCVPGYQGRHCDLEVNECASDPCKNEATCLNEIGRYTCICPHDYSGVNCELEIDECWSQPCLNGATCQDALGAYFCNCAPGFLGDHCELNIDECASQPCLHGGLCVDGENRYSCNCTGSGFTGTHCEILMPLCWSKPCYNNATCEDSVDNYTCHCWPGYTGAQCEIDINECNSNPCQSNGECVELSSEKQYGHITGLPSSFSYHEASGYVCICQPGFTGIHCEEDVNECSSNPCQNGGTCENLPGNYTCHCPFDNLSRTFYGGRDCSDILLGCTHQHCLNHGICIPHFQDGQHGFSCLCPSGYTGSLCEIATTLSFEGNGFLWVKSGSVTTKGSVCNIALRFQTVQPMALLLFRSNRDVFVKLELLSGYIHLSIQVNNQSKVLLYISHNTSDGEWHFVEVIFAEAVTLTLIDDSCKKKCIAKAPSPLESDQSICAFQNSFLGGLPVGTTSNGVALLNFYNIPSTPSFVGCLQDIKIDWNHITLENISSGSSLNVKAGCVRKDWCESQPCQSRGRCINLWLNYQCDCHRPYKGPNCLREYVAGRFGQDDSTGYVVFTLDESYGDTISLSMFVRTLQPSGLLLALENSTYQYIRVWLEHGRLAMLTPNSPKLVVKFVLNDGNVHLISLKIKPNKIELYQSSQNLGFISASTWKIQKGDVIYIGGLPDKQDTELNGGFFKGCIQDVRLNNQNLEFFPNSTNDASLNPVLVNVTQGCPGDNSCKSNPCHNGGVCHSLWDDFSCSCPAHTSGKACEEVQWCGFSPCPRGAQCQPVLQGFECIANAVFHGQSSQTLFRSNGNITRELTNITFGFRTRDANVIILHAEKEPEFLNISIQDSRLFFQLQSGNSFYMLSLTSLQSVNDGTWHEVTLSMTDPLSQTSRWQMEVDNQTPFVTSTIATGSLNFLKDNTDIYVGDGAIDNIKGLQGCLSTIEIGGIYLSYFENVHGFTNKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISDTNGYSCLCFGNFTGKFCRQSRLPSTVCGNEKTNLTCYNGGNCTEFQAELKCMCRPGFTGERCEKDIDECASDPCVNGGRCQDLLNKFQCLCDVAFAGERCEVDLADDLISDIFTAIGSVTLALLLILLLAIVASVVTSNKRATQGTYSPSRQEKEGSRVEMWNLMPPPAMERLI

SEQ ID NO: 15 - protein, 1406 aa, Gorilla gorilla
  MISC_FEATURE: Gorilla gorilla CRB1 isoform 1
MALKNINYLLIFYLSFSLLIYIKNSFCNKNNTRCLSNSCQNNSTCKDFSKDNDCSCSDTANNLDKDCDNMKDPCISNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDINECNSNPCQSNGECVELSSEKQYGRITGLPSAFSYHEASGYVCICQPGFTGIHCEEDVNECSSNPCQNGGTCENLPGNYTCHCPFDNLSRTFYGGRDCSDILLGCTHQQCLNNGTCIPDFQDGQHGFSCLCPSGYTGSLCEITTTLSFEGDGFLWVKSGSVTTKDSVCNVALRFQTVQPMALLLFRSNRDVFVKLELLSGYIHLSIQVNNQSKVLLFISHNTSDGEWHFVEVIFAEAVTLTLIDDSCKEKCIAKAPSPLESDQSICAFQNSFLGGLPVGMTSSGVALPNFYNIPSTPSFVGCLQDIKIDWNHITLENISSGSSLNVKAGCVRKDWCESQPCQSRGRCINLWLSYQCDCHRPYKGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPNKIELYQSSQNLGFISASTWKIKKGDVIYIGGLPDKQETELNGGFFKGCIQDVRLNNQTLEFFPNPANNASLNPVLVNVTQGCPGDNSCKSNPCHNGGVCRSRWDDFSCSCPAHTSGKACEEVQWCGFSPCPRGAQCQPVLQGFECIANAVFNGQSSQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQAELKCMCRPGFTGEWCEKDIDECASDPCVNGGLCQDLLNKFQCLCDVAFAGERCEVDLADDLISDIFTTIGSVTLALLLILLLAIVASVVTSNKRAAQGTYSPSRQEKEGSRVEMWNLMPPPAMERLI

SEQ ID NO: 16 - protein, 1407 aa, Gorilla gorilla
  MISC_FEATURE: Gorilla gorilla CRB1 isoform 2
SQRKIFNFVLIYKFNLVTFYFLVDSFCNKNNTRCLSNSCQNNSTCKDFSKDNDCSCSDTANNLDKDCDNMKDPCISNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDINECNSNPCQSNGECVELSSEKQYGRITGLPSAFSYHEASGYVCICQPGFTAGIHCEEDVNECSSNPCQNGGTCENLPGNYTCHCPFDNLSRTFYGGRDCSDILLGCTHQQCLNNGTCIPDFQDGQHGFSCLCPSGYTGSLCEITTTLSFEGDGFLWVKSGSVTTKDSVCNVALRFQTVQPMALLLFRSNRDVFVKLELLSGYIHLSIQVNNQSKVLLFISHNTSDGEWHFVEVIFAEAVTLTLIDDSCKEKCIAKAPSPLESDQSICAFQNSFLGGLPVGMTSSGVALPNFYNIPSTPSFVGCLQDIKIDWNHITLENISSGSSLNVKAGCVRKDWCESQPCQSRGRCINLWLSYQCDCHRPYKGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPNKIELYQSSQNLGFISASTWKIKKGDVIYIGGLPDKQETELNGGFFKGCIQDVRLNNQTLEFFPNPANNASLNPVLVNVTQGCPGDNSCKSNPCHNGGVCRSRWDDFSCSCPAHTSGKACEEVQWCGFSPCPRGAQCQPVLQGFECIANAVFNGQSSQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQAELKCMCRPGFTGEWCEKDIDECASDPCVNGGLCQDLLNKFQCLCDVAFAGERCEVDLADDLISDIFTTIGSVTLALLLILLLAIVASVVTSNKRAAQGTYSPSRQEKEGSRVEMWNLMPPPAMERLI

SEQ ID NO: 17 - protein, 1406 aa, Macaca mulatta
  MISC_FEATURE: Macaca mulatta CRB1 isoform 1
MALKNINYLLIFYLSFSLLIYIKNSFCNKNNTRCLSNSCQNNSTCKGFSKDNDCSCSGTANNVDKDCDNVKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPRDYSGINCELEIDECWSQPCLNGATCQDALGAYFCDCAPGFLGDHCELNIDECASQPCLHGGLCVDGENRYSCNCTGSGFTGTHCETLMPLCWSKPCHNNATCEDSVDNYTCHCWPGYTGAQCEIDINECNSNPCQSDGECVELSSEKQYGHITGLPSTFSYHEASGYVCICQPGFTGIHCEEDVNECSSNPCQNGGTCENLPGNYTCHCPFDNLSRTFYGGRDCSDILLGCTHQQCLNNGICIPHFQDGQHGFGCLCPSGYTGSLCEIATTLSFEGDGFLWVKTGSATTKGSVCNIALRFQTVQPVALLLFRGNRDVFVKLELLSGYIHLSIQVNSQPKVLLYISHNTSDGEWHFVEVIFAEAVTLTLIDDSCKEKCISKAPSPLESDQSICAFQNSFLGGLPVGTTSDGVALLKFYNIPSTPSFVGCLQDIKIDWNHITLENISSVSSLNVKAGCVRKDWCESQPCQSRGRCINLWLSYQCDCHRPYKGPNCLREFVAGRFGQNDSTGYVVFTLDESYGDTVSLSMFVQTLQPSGLLLALENSTYQYIRVWLEHGRLAMLTPNSPKLVVKFVLNDGNVHLISLKIKPNKIELYQSSQNLGFISASTWKIQKGDVIYIGGLPDKQETELNGGFFKGCIQDVRLNNQNLEFFPNSTNNVSLKPVLVNVTQGCPGDNSCKSNPCRNGGVCHSLWDDFSCSCPAHMSGKACEEVQWCGFSPCPHEAQCQPVLQGFECIANAVFNEQSSQILFRSNGNITRELTNITFGFRTRDANVIILHAEKEPEFLNISIQDSRLFFQLQSGNSFYMLSLTSLQSVNDGMWHEVTLSMTDPMSQTSRWQMEVDNQTPFVTSTIATGSLNFLKDNTDIYVGDGAIDNIKGLQGCLSTIEIGGIYLSYFENVHGFTNKPQEEQFLKISTNSVVTGCLQLSVCNSNPCLHGGNCEDIYSSYHCSCPLGWSGKHCELNTDECFSNPCIHGNCSDRVAAYHCTCEPGYTGGNCEVDIDNCQSHQCANGATCISDTNGYSCLCFGNFTGKFCRQSRLPSTVCGNEETNLTCYNGGNCTEFQAELKCMCRPGFTGERCEKDIDECASDPCVNGGLCQDLLNKFQCLCDVAFAGERCEVDLADDLISDIFTAIGSVTLALLLILLLAIVASVVTSNKRATQGTYSPSRQEKEGSRVEMWNLMPPPAMERLI

SEQ ID NO: 18 - protein, 1294 aa, Macaca mulatta
  MISC_FEATURE: Macaca mulatta CRB1 isoform 3
MALKNINYLLIFYLSFSLLIYIKNSFCNKNNTRCLSNSCQNNSTCKGFSKDNDCSCSGTANNVDKDCDNVKDPCFSNPCQGSATCVNTPGERSFLCKCPPGYSGTICETTIGTCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPLDYSGYTGAQCEIDINECNSNPCQSDGECVELSSEKQYGHITGLPSTFSYHEASGYVCICQPGFTGIHCEEDVNECSSNPCQNGGTCENLPGNYTCHCPFDNLSRTFYGGRDCSDILLGCTHQQCLNNGICIPHFQDGQHGFGCLCPSGYTGSLCEIATTLSFEGDGFLWVKTGSATTKGSVCNIALRFQTVQPVALLLFRGNRDVFVKLELLSGYIHLSIQVNSQPKVLLYISHNTSDGEWHFVEVIFAEAVTLTLIDDSCKEKCISKAPSPLESDQSICAFQNSFLGGLPVGTTSDGVALLKFYNIPSTPSFVGCLQDIKIDWNHITLENISSVSSLNVKAGCVRKDWCESQPCQSRGRCINLWLSYQCDCHRPYKGPNCLREFVAGRFGQNDSTGYVVFTLDESYGDTVSLSMFVQTLQPSGLLLALENSTYQYIRVWLEHGRLAMLTPNSPKLVVKFVLNDGNVHLISLKIKPNKIELYQSSQNLGFISASTWKIQKGDVIYIGGLPDKQETELNGGFFKGCIQDVRLNNQNLEFFPNSTNNVSLKPVLVNVTQGCPGDNSCKSNPCRNGGVCHSLWDDFSCSCPAHMSGKACEEVQWCGFSPCPHEAQCQPVLQGFECIANAVFNEQSSQILFRSNGNITRELTNITFGFRTRDANVIILHAEKEPEFLNISIQDSRLFFQLQSGNSFYTLSLTSLQSVNDGMWHEVTLSMTDPMSQTSRWQMEVDNQTPFVTSTIATGSLNFLKDNTDIYVGDGAIDNIKGLQGCLSTIEIGGIYLSYFENVHGFTNKPQEEQFLKISTNSVVTGCLQLSVCNSNPCLHGGNCEDIYSSYHCSCPLGWSGKHCELNTDECFSNPCIHGNCSDRVAAYHCTCEPGYTGGNCEVDIDNCQSHQCANGATCISDTNGYSCLCFGNFTGKFCRQSRLPSTVCGNEETNLTCYNGGNCTEFQAELKCMCRPGFTGERCEKDIDECASDPCVNGGLCQDLLNKFQCLCDVAFAGERCEVDLADDLISDIFTAIGSVTLALLLILLLAIVASVVTSNKRATQGTYSPSRQEKEGSRVEMWNLMPPPAMERLI

SEQ ID NO: 19 - protein, 1407 aa, Equus caballus
  MISC_FEATURE: Equus caballus CRB1 isoform 1
MKALQKINYLLIFYLSFSPFIYIKNSFCNKNDTNCLSNSCQSNSTCNGFSKDSDCRCSDTASNLDKGCDNMKDPCFSSPCQGNATCVNTPGERSFLCKCPPGYNGTTCETVTSSCGMNSCQHGGICRQDPVHPVCLCPAGYAGRFCEMDHDECASSPCHNGAVCQDGLNGYSCFCVPGFQGRHCDLEVDECVSDPCKNAGTCLNEIGRYTCVCPQDYSGVNCEMEIDECWSQPCLNGATCQDALRAYFCACTPGFLGDHCELNVDECASQPCLHGGLCVDGSNRYSCNCKGSGFTGTHCETLMPLCWSQPCHNNATCEDSADNYTCHCWPGYTGAQCETDINECSSNPCQSDGECVERSSEQQYGRLAQLPSSFSYPEASGYVCICQPGFTGIFCEEDIDECSSNPCQNGGTCENLPGNYTCHCPFDNRSGTFYGGRDCSDILLGCTHHQCLNNGICIPHFQNGQHGFSCLCPSGYTGSLCEIVTTLSFEGNGFLGVTSGSVTAEGSVCSIALKFQTVQPMALLLLRGDGDMFVMLELLSGYIHLSVQVNNQSKVLLYISHNTSDGEWHSVEVVFADTVTLTLLDDSCKEKCITKAPSPFGKDRSICAFPNSFLGGLPMGMNSNGVALLNIYNRPSTPSFVGCLQDIKIDSNHITPENISSGSSLNIKPGCMRKDWCESQPCQNRGRCTNLWLSYQCDCHRPYGGLNCLKEYVAGRFGQDDSSGYAVFNLDKSYGENFTLSMFVRTHRPSGLLLALGNSTYQFIRVWLEHGRLAMLNPSSPKLVVKFVLSDGNIHLISLKIKPNKIELYQSSQNLGFISAPTWNIQRGDVIYIGGLPDRQETEVNGGFFKGCVQDIRLNNQNLEFFPNSTSNSSRNPILVNVTQGCPGDDMCKSNPCHHGGVCYSLWDDFSCSCPANTAGKACEDVQWCELSPCPSGAQCQLVPQGFECTANAVFNGQSSEILFRSNGNITRELTNITFGFRTRDASGIILHAEKEPEFLSISIRDSRLLFQLQSGNSFYMLSLTSVQSMNDGIWHQVSLSMTDPLAQASRWQMEVDNQTPFVTSAVATGSLNFLKDNTDIYVGHRASDNMQGLQGCLSTIEIGGIYLSYFENVRGFIKKPQQEQFLKTSVNSVVTGCLQLNACNSNPCLQGGDCEDIYSSYHCSCPLGWSGTQCELNIDECFSNPCIHGNCSDRLAAYHCKCEPGYTGVNCEAFIDNCRSHQCANGATCISDANGYSCRCSGNFTGKFCRHSRLPATVCGNEQTNLTCYNGGSCTEFPGGFKCVCRPGFTGERCEKDIDECASDPCFNGGLCQDLLNRFQCLCDVAFAGERCEIDLAGDLISDIFTAIGSVTLALLLILFLAIAASVVASNKRATQGTYSPSRQEKEGSRVEMWSMMPPPVMERLI

SEQ ID NO: 20 - protein, 1381 aa, Ailuropoda melanoleuca
  MISC_FEATURE: Ailuropoda melanoleuca CRB1 isoform 1
SFCNKNDTRCLSNSCQNNSTCNDHPKDNKCHCSDAAINLDKDCDNVKDPCFSNPCQENATCVNTPGERSFLCKCPPGFSGTTCETAIVFCGTNACQHGGVCHQDPLHPVCICPDGYAGRFCEKDLDECASSPCHNGAVCQDGISGYSCFCVPGYQGRHCDLEVDECVSDPCKNEATCLNEIGRYTCICPRNYSGVNCEMEVDECWSQPCRNGATCRDALGAYFCDCPLGFVGDHCELNSDECASQPCLHGGLCVDGQRSYSCNCTGSGFTGTHCETLMPLCWSKPCHNNATCEDSADNYTCHCWPGYTGAQCETHINICNRNPCKSGGTCVELSPEEQYGRLAQLPSSFSHPEASGYVCICLPGLTGIHCEEDIDKCSSNPCQNGGTCENLPGHYTCHCPFDNHSGTFYGGRNCSDILLGCSHHQCLNNGICIPHVQNGQHGFSCLCPSGYTGSLCELVTTLSFEGNGFLWITSGPVTGEDLACNIALSFQTVQPMALLLFRGNRDMFIMLELLSGYIHLSIQVNNQSKVLLYISHNTSDGEWHSIEVMFAEAVTLTLLDNSCKEKCITKAPSPFGSDQSICAFQNSFLGGLPGGTSSSGTALLNICNIPSTPSFVGCLQDVTIDSNHITPEDISSGSSLNVKAGCVRKDWCESQPCQNRGRCINLWLNFQCDCYRPYKGPNCMREYVAGRFGQDDSTGYAAFDLDESYGENFTISMFVRTYRPSGLLLALENRTYQYIRVWLEHGRLAMLHPGSSKLVVKFVLSDGNVHLISLKIKPDKIELYQSSQNLGFISAPTWKIQKGDVMYIGGLPDRPETEANGGFFKGCIQDIRLNNQNMEFFPNSTNNASHNPVLVNVTQGCPGDNMCKSNPCHNGGVCYSLWDDFSCSCPANTAGKACEQVRWCELSPCPPTAQCREVPRGFECIANAVFNAQSSEILFRSNGNITRELTNITFGFRTRDANVIILHAEKEPEFLNISIQDSRLLFQLQSGNSFYTLSLTSLQSVNDGMWHQVTLSMTDPLAQASRWQMEVDNQAPFVTSAVATGSLNFLKDNTDIYVGDRAVDTQGLKGCLSTIEIGGIYLSYFENVPGFTSKPQEEQFLKISINSVATGCLPLNACHSSPCLHGGNCDDIYSAYHCSCPLGWSGTRCELNIDECFSNPCIHGNCSDRVAAYHCRCEPGYTGVNCEMDIDNCQSHQCANGATCINNTNGYSCHCFGNFTGKFCRHTRLPSTVCGNEKTNLTCYNGGNCSEFQGELKCLCRPGFTGEWCEKDIDECASDPCFNGGLCQDLVNKFQCLCDVAFAGERCEVDLADDMISDIFTAVGSVTSALLLTLFLVVVVSVVASNKRATQGTYSPSRQEKEGSRVEMRSMMPPSAVERLI

SEQ ID NO: 21 - protein, 1409 aa, Ailuropoda melanoleuca
  MISC_FEATURE: Ailuropoda melanoleuca CRB1 isoform 2
CFLKNINAIYLFVNFIPIFFYFPVGSFCNKNDTRCLSNSCQNNSTCNDHPKDNKCHCSDAAINLDKDCDNVKDPCFSNPCQENATCVNTPGERSFLCKCPPGFSGTTCETAIVFCGTNACQHGGVCHQDPLHPVCICPDGYAGRFCEKDLDECASSPCHNGAVCQDGISGYSCFCVPGYQGRHCDLEVDECVSDPCKNEATCLNEIGRYTCICPRNYSGVNCEMEVDECWSQPCRNGATCRDALGAYFCDCPLGFVGDHCELNSDECASQPCLHGGLCVDGQRSYSCNCTGSGFTGTHCETLMPLCWSKPCHNNATCEDSADNYTCHCWPGYTGAQCETHINICNRNPCKSGGTCVELSPEEQYGRLAQLPSSFSHPEASGYVCICLPGLTGIHCEEDIDKCSSNPCQNGGTCENLPGHYTCHCPFDNHSGTFYGGRNCSDILLGCSHHQCLNNGICIPHVQNGQHGFSCLCPSGYTGSLCELVTTLSFEGNGFLWITSGPVTGEDLACNIALSFQTVQPMALLLFRGNRDMFIMLELLSGYIHLSIQVNNQSKVLLYISHNTSDGEWHSIEVMFAEAVTLTLLDNSCKEKCITKAPSPFGSDQSICAFQNSFLGGLPGGTSSSGTALLNICNIPSTPSFVGCLQDVTIDSNHITPEDISSGSSLNVKAGCVRKDWCESQPCQNRGRCINLWLNFQCDCYRPYKGPNCMRDTEEYVAGRFGQDDSTGYAAFDLDESYGENFTISMFVRTYRPSGLLLALENRTYQYIRVWLEHGRLAMLHPGSSKLVVKFVLSDGNVHLISLKIKPDKIELYQSSQNLGFISAPTWKIQKGDVMYIGGLPDRPETEANGGFFKGCIQDIRLNNQNMEFFPNSTNNASHNPVLVNVTQGCPGDNMCKSNPCHNGGVCYSLWDDFSCSCPANTAGKACEQVRWCELSPCPPTAQCREVPRGFECIANAVFNAQSSEILFRSNGNITRELTNITFGFRTRDANVIILHAEKEPEFLNISIQDSRLLFQLQSGNSFYTLSLTSLQSVNDGMWHQVTLSMTDPLAQASRWQMEVDNQAPFVTSAVATGSLNFLKDNTDIYVGDRAVDTQGLKGCLSTIEIGGIYLSYFENVPGFTSKPQEEQFLKISINSVATGCLPLNACHSSPCLHGGNCDDIYSAYHCSCPLGWSGTRCELNIDECFSNPCIHGNCSDRVAAYHCRCEPGYTGVNCEMDIDNCQSHQCANGATCINNTNGYSCHCFGNFTGKFCRHTRLPSTVCGNEKTNLTCYNGGNCSEFQGELKCLCRPGFTGEWCEKDIDECASDPCFNGGLCQDLVNKFQCLCDVAFAGERCEVDLADDMISDIFTAVGSVTSALLLTLFLVVVVSVVASNKRATQGTYSPSRQEKEGSRVEMRSMMPPSAVERLI

SEQ ID NO: 22 - protein, 1408 aa, Bos taurus
  MISC_FEATURE: Bos taurus CRB1 isoform 1
MALRTVNHRLLLCLSLSLLISIKSSFCNKNDTKCLSDSCQKNSTCKDFSKDKSCRCSDTAVHGDKDCGEEEDPCLSSPCPGHATCARVPGERRSRCRCPPGHSGAGCDTAAGPCGPRSCLHGGVCHQDPGPPVCVCPAGYAGRFCELDLDECASSPCLHGAMCQDRGDGYSCFCVPGYQGRHCDVEVDECVSEPCRNAATCLNEIGRYTCLCPRGFSGVNCELEVDECWSQPCLNGATCRDAAGAYFCDCAPGFLGDHCELNTDECASGPCLHGGLCVDGANRYSCTCAGSGFTGTRCETLLPPCWSEPCHNNAICEDSADRYTCRCRPGYTGAQCETDLDGCGSGPCQAGGRCVELSSETGRERLARLLSASRRPEASGYVCICPPGLTGVHCEEDVDECLSSPCRNGGTCENSPEGYTCHCPFDPHSGVFFGGRDCSDILLGCADHPCLNNGTCVPHVHDGQHGFDCLCPPGYTGSRCGTVTTLSFLGSGFLWVSSGSALAQDSGCTVALRFQTVQPAALLLFRGDRDVFVMLEVLAGFVHLTVQVSDRPKVVLLIPHDTSDGGWHAVEATFAEAVTLALRDDSCMGTCVARAPSPFESDGSSACALQNSFLGGLPEGRAHSGDALLNVYRIPSAPSLVGCLQDVHLDSNAITAENVSSDQSLNVKAGCARKDWCESQPCRNRGRCLNLWLGHRCECYRPYRGRSCHGEYVAGRFGQDDSPGYAVFHLNKDYEEDLTLSMFVRTRRPTGLLLALGNGTYQYLRVWLEHGRLAMLTPGSPKLLVTFVLSDGNVRLVSLKIKPNKIELYESSQNLGFLSAPTWKLQRGDVLYVGGLPDRRETEVSGGFFKGCIQDMRLNNENLEFFPNPTSSAAHNAVLVNVTEGCPGDNLCEPNPCHHGGICYPLWDDFSCSCPVNTAGKACQELRWCELGPCPPGAQCLRLPRGFECIANAVFNGQSREIIFRSNGNITRELTNVTFGFRTRDAHAIILHAEKEPEFLRIHIQDSRLLFQLRSGNSFYTLSLTSLQPVSDGVWYQVTISMTDPGAQASRWQMEVDGQTPPVTSAVAAGSLSFLKDDTDVYVGDRASDSTRALRGCLSTIAISGLYLSYFENVRGLMNRPQEERFLKVSRPPVETGCLQLDACRSGPCLHGGRCEDTYSSHRCTCPAGRSGPHCEFHVDECLSSPCIHGNCSAPGGTAYHCRCEPGFTGVNCESEVDHCQHHQCANGATCVSDANGYSCRCPGNFTGRFCRYLRLPSTVCGNEKANLTCYNGGNCTAFQGEMKCACGPGFTGERCDKDIDECASDPCLHGGRCHDLLNGFRCVCALAFAGPRCELDLADDLLSDVFTTIGSVTLALLLILFLAVVASVLASNKRATQGSYSPSRQEKDSSRVEMWSVMDAPAAERLI

SEQ ID NO: 23 - protein, 1405 aa, Cavia porcellus
  MISC_FEATURE: Cavia porcellus CRB1 isoform 1
MELQKINSLLIYLSFSLLIYIQNSFCDKNTTRCLSNSCQNNSTCKSFSQDSKCHCSDTANNLDEDCDNMKDPCSSNPCQGIATCMNTPGERGFQCQCPPGYNGVTCETALGSCGMGSCQHGGTCLQDPVHPVCICPAGYGGRFCEIDHDECASSPCHNGAVCQDAINGYFCFCVPGYQGRHCDLEVDECVSDPCKNEAICLNEIGRYTCICPQDYSGVNCELQVDKCWSQPCLNGATCRDALEAYFCDCAPGFLGDHCELSIDECASQPCLHGGLCVDGRNRYSCNCVGSGFTGTHCETLMPVCWSKPCHNNATCEDSVDNYICHCWPGYSGAQCETDINECSSNPCQSGGECVERSLEKQYGRIAQLPPPFSYHEAAGYVCVCQPGFTGIHCEEDINECLSHPCKNGGTCENLPGNYSCHCPFDNLSRTFYGGQDCSDILLGCTHRQCLNNGICIPHFHNGHHGFSCLCPSGFTGSLCEAVTTLSFGGNSFLWVTSGSHTTKSSVCNIIFRFQTVQPMALLFIWGSRDMFAKLELLHGYIHLSVRVHNQLRVLLYISHNTSDGLWHLVEVIFSETVTLSLTDDSCKEKCVTDAPSPFEINQSICAFRDSFLGGLPVEMTRDGIALLDIYNTASTPSFVGCLQDIKFDSNPITLENISSGLSLNIKAGCMRKDWCKSQPCQNRGRCINLWLGYQCDCYRPYAGPNCVREYVAGRFGLDGSAAYAVFKVDENYGRNFSLSMFVRTHRPSGFLLALENSTYHYIRVWLEHGRLALLTPGSPKLLAKFVLSDGNFHLISLKIKSNRIELFQSSQKLGFISAPTWKIQKGDVIYIGGLPDRQETEINSGFFKGCIQDIRLNNQNLEFFPNSTNSSSHHPVLVNVVQGCPGDNVCKSNPCFNGGVCYALWDDFSCACPANTAGKACEEVRWCELSPCPASTRCQPVPRGFECIGNVVLSGQSSNILFQSNGNITRELTNITFGFRTRDANVIILHAENEPAFLNISIQDSRLSFQLQSGNNFYILQLRSLQSVNDGTWHQVTLSMTDPLAPISRWQMKLDNQTSFVTSAIATGSLNFLKDNTDIYVGDSFIDNMKGFQGCLSTIEIGGIYLSYFENVHGVTNKPQEEQFLKISTNLVLTGCLQLNACLSNPCLHGGDCEDLYSSYHCSCPSGWSGSHCELNIDECFSNPCIHGNCSDRVAAYQCRCEPGYTGVNCEAEIDNCQSHQCANGATCISDTNGYSCLCFGNFTGKFCRHSRLPSTVCGNGITNLTCYNGGNCTEFHAELKCMCRAGFTGERCEQDIDECASAPCLNGGLCQDLLGRFQCLCDVAFAGDRCELDLAGDMTSDLLTAIGSVTSVLLLILLLAVIASIAASNKRATQGTYNPSLQEKEGARVEMWSVTPPPTMERLI

SEQ ID NO: 24 - protein, 1383 aa, Callithrix jacchus
  MISC_FEATURE: Callithrix jacchus CRB1 isoform 1
MKDPCFSNPCQGSATCVNMPGERSFLCKCPPGYSGTSCETTIGSCGMNSCQHGGICHQDPIYPVCICPAGYAGRFCEIDHEECASSPCQNGAMCQDGIDGYSCFCVPGYQGRHCDLEVDECASDPCKNEATCLNEIGRYTCICPHDYSGVNCELEIDECWSQPCLNGASCRDALGAYFCDCAPGFLGDHCELNIDECASLPCLHGGLCVDEENRYSCNCTGSGFTGTHCETLMPPCWSKPCHNNATCEDSVDNYTCHCWPGYTGVQCEIYINECSSNPCQSHGECVELSSEKQYGHIVGLPSSFSYHEASGYVCICQPGFTGIHCEEDVNECSSNPCQNGGTCENLPGNYTCHCPFDNLSRTFYGGRDCSDILLGCTHQQCLNNGICIPHFQDGQHGFSCLCPSGYTGSLCEIATTLSFEGDGFLWVTSDSATTKDSMCNMALRFQTVQPMALLLFRGNRDVFLKLELLSGYVHLSIQVDQQPKVLLYISHNTSDGEWHFVEVIFAEAVTLTLIDNSCKEKCITKAASPFESDQSVCAFQNSFLGGLPVGRTSRGAALLNFYNIPSTPSFVGCLQDIKIDWNHITLQNISSGSSLNVKPGCVRKDWCESQPCQSRGHCINLWLSYQCDCHRPFKGSNCLKEYVAGKFGQDDSTGYAVFTLDESYGDTVSLSMFVRTLHPSGLLLALENSTYQYIRVWLEHGRLVMLTPSSPKLVAKFVLNDGNVHLITLKIKPNKIELFKSSQNLGFISASTWKIQKGDVIYVGGLPDRQKTELNGGFFKGCIQDVRLNNQNLEFFSNSTNEALLNRVLVNVTQGCPGDNICEVRKTNAGRAVTEIGSKGPRYQVSLFRLCTGSWATGNIFCLSSEKTGSNPCHNGGVCHSLWDDFFCSCPANTSGKACEEAQWCGLSPCPPRAQCQLVPQGFECIANAVFNGQSSQILFRSNGNITRELTNITFGFRTRDANVIILHAEKEPEFLNISIQDSRLFFQLQSGNSFYTLSLMSLQSVNDGMWHQVTLSMTDPVAQTSRWQMEVDNQTPFVTSTIATGSLNFLKDNTDIYVGDRAIDNTKGLQGCLSTIEIGGIYLSYFENVHGFTNKPQEEQFLKISTDSVVTGCLQLNACNSNPCLHGGSCEDIYSSYHCSCPLGWSGKHCELNIDECFSNPCIHGNCSDRVAAYHCRCEPGYTGVNCEVAKDNCQRHQCANGATCISDTNGYSCLCLGNFTGKFCRQSRLPSTVCGNERTNLTCYNGGNCTEFQAELKCMCWPGFTGERCEKDIDECASDPCVNGGLCQDLLNKFQCLCDVAFAGERCEVDLAGGLISDVFTALGSVTLALLLILLLAVVASVVTSNKRATQGTYSPSRQEKEGSRVEMWNLMPPPAMERLI

SEQ ID NO: 25 - protein, 1376 aa, Callithrix jacchus
  MISC_FEATURE: Callithrix jacchus CRB1 isoform 2
MALKNIKYLLIFYLSFSLLIYIKNSFCNKNNTRCLSNSCQNNSTCKGFSKDNDCSCSDTANNLDKDCDNMKDPCFSNPCQGSATCVNMPGERSFLCKCPPGYSGTSCETTIGSCGMNSCQHGGICHQDPIYPVCICPAGYAGRFCEIDHEECASSPCQNGAMCQDGIDGYSCFCVPGYQGRHCDLEVDECASDPCKNEATCLNEIGRYTCICPHDYSGVNCELEIDECWSQPCLNGASCRDALGAYFCDCAPGFLGDHCELNIDECASLPCLHGGLCVDEENRYSCNCTGSGFTGTHCETLMPPCWSKPCHNNATCEDSVDNYTCHCWPGYTGVQCEIYINECSSNPCQSHGECVELSSEKQYGHIVGLPSSFSYHEASGYVCICQPGFTGIHCEEDVNECSSNPCQNGGTCENLPGNYTCHCPFDNLSRTFYGGRDCSDILLGCTHQQCLNNGICIPHFQDGQHGFSCLCPSGYTGSLCEIATTLSFEGDGFLWVTSDSATTKDSMCNMALRFQTVQPMALLLFRGNRDVFLKLELLSGYVHLSIQVDQQPKVLLYISHNTSDGEWHFVEVIFAEAVTLTLIDNSCKEKCITKAASPFESDQSVCAFQNSFLGGLPVGRTSRGAALLNFYNIPSTPSFVGCLQDIKIDWNHITLQNISSGSSLNVKPGCVRKDWCESQPCQSRGHCINLWLSYQCDCHRPFKGSNCLKEYVAGKFGQDDSTGYAVFTLDESYGDTVSLSMFVRTLHPSGLLLALENSTYQYIRVWLEHGRLVMLTPSSPKLVAKFVLNDGNVHLITLKIKPNKIELFKSSQNLGFISASTWKIQKGDVIYVGGLPDRQKTELNGGFFKGCIQDVRLNNQNLEFFSNSTNEALLNRVLVNVTQGCPGDNICESNPCHNGGVCHSLWDDFFCSCPANTSGKACEEAQWCGLSPCPPRAQCQLVPQGFECIANAVFNGQSSQILFRSNGNITRELTNITFGFRTRDANVIILHAEKEPEFLNISIQDSRLFFQLQSGNSFYTLSLMSLQSVNDGMWHQVTLSMTDPVAQTSRWQMEVDNQTPFVTSTIATGSLNFLKDNTDIYVGDRAIDNTKGLQGCLSTIEIGGIYLSYFENVHGFTNKPQEEQFLKISTDSVVTGCLQLNACNSNPCLHGGSCEDIYSSYHCSCPLGWSGKHCELNIDECFSNPCIHGNCSDRVAAYHCRCEPGYTGVNCEVAKDNCQRHQCANGATCISDTNGYSCLCLGNFTGKFCRQSRLPSTVCGNERTNLTCYNGGNCTEFQAELKCMCWPGFTGERCEKDIDECASDPCVNGGLCQDLLNKFQCLCDVAFAGERCEVDVSDLSFYVSLLFWQNLFQLLSYLILRMNDEPVVEWGEQEDY

SEQ ID NO: 26 - protein, 1294 aa, Callithrix jacchus
  MISC_FEATURE: Callithrix jacchus CRB1 isoform 3
MALKNIKYLLIFYLSFSLLIYIKNSFCNKNNTRCLSNSCQNNSTCKGFSKDNDCSCSDTANNLDKDCDNMKDPCFSNPCQGSATCVNMPGERSFLCKCPPGYSGTSCETTIGSCGMNSCQHGGICHQDPIYPVCICPAGYAGRFCEIDHEECASSPCQNGAMCQDGIDGYSCFCVPGYQGRHCDLEVDECASDPCKNEATCLNEIGRYTCICPHDYSGYTGVQCEIYINECSSNPCQSHGECVELSSEKQYGHIVGLPSSFSYHEASGYVCICQPGFTGIHCEEDVNECSSNPCQNGGTCENLPGNYTCHCPFDNLSRTFYGGRDCSDILLGCTHQQCLNNGICIPHFQDGQHGFSCLCPSGYTGSLCEIATTLSFEGDGFLWVTSDSATTKDSMCNMALRFQTVQPMALLLFRGNRDVFLKLELLSGYVHLSIQVDQQPKVLLYISHNTSDGEWHFVEVIFAEAVTLTLIDNSCKEKCITKAASPFESDQSVCAFQNSFLGGLPVGRTSRGAALLNFYNIPSTPSFVGCLQDIKIDWNHITLQNISSGSSLNVKPGCVRKDWCESQPCQSRGHCINLWLSYQCDCHRPFKGSNCLKEYVAGKFGQDDSTGYAVFTLDESYGDTVSLSMFVRTLHPSGLLLALENSTYQYIRVWLEHGRLVMLTPSSPKLVAKFVLNDGNVHLITLKIKPNKIELFKSSQNLGFISASTWKIQKGDVIYVGGLPDRQKTELNGGFFKGCIQDVRLNNQNLEFFSNSTNEALLNRVLVNVTQGCPGDNICESNPCHNGGVCHSLWDDFFCSCPANTSGKACEEAQWCGLSPCPPRAQCQLVPQGFECIANAVFNGQSSQILFRSNGNITRELTNITFGFRTRDANVIILHAEKEPEFLNISIQDSRLFFQLQSGNSFYTLSLMSLQSVNDGMWHQVTLSMTDPVAQTSRWQMEVDNQTPFVTSTIATGSLNFLKDNTDIYVGDRAIDNTKGLQGCLSTIEIGGIYLSYFENVHGFTNKPQEEQFLKISTDSVVTGCLQLNACNSNPCLHGGSCEDIYSSYHCSCPLGWSGKHCELNIDECFSNPCIHGNCSDRVAAYHCRCEPGYTGVNCEVAKDNCQRHQCANGATCISDTNGYSCLCLGNFTGKFCRQSRLPSTVCGNERTNLTCYNGGNCTEFQAELKCMCWPGFTGERCEKDIDECASDPCVNGGLCQDLLNKFQCLCDVAFAGERCEVDLAGGLISDVFTALGSVTLALLLILLLAVVASVVTSNKRATQGTYSPSRQEKEGSRVEMWNLMPPPAMERLI

SEQ ID NO: 27 - protein, 1378 aa, Gallus gallus
  MISC_FEATURE: Gallus gallus CRB1 isoform 1
MRNDSRCLSNSCQKNSTCITGHRDDICRCVDMSLDTMEELCNKTSDPCSSNPCLQNATCLSSAGNLNFTCECPDGYNGTTCEIAISMCDTNPCEHGGTCLDGLARPTCLCRTGFTGTRCEMDVDECSSEPCHNGAVCRDGIDEYSCYCVPGYQGKHCDLEVNECVSDPCLNGATCLNLIGRYYCICPLGYTGVNCELEVDECQSRPCQNGATCRDAPAAFSCSCPPGFLGALCQTDVDECASGPCLHGALCADRPGGCAWGRGGERAEGGHMEQQLLMQNYLQPIHKSINEENSGSFPSPLALAGYTGSHCETDISECSSAPCASGRCLERSWAARYGHEPALQLPFRHDRAEGYVCACPPGIRGIHCDEDINECHTNPCQNGGICENFPGNYTCHCPPADKEGIFYGGWNCTEILRGCTDQQCQNNGICIPHLKNGHHGFSCICSPGYTGIHCETVTTFSFQGNGFLWLKNPTTTKEESSYNINLRFQTVQPTAFLFYRGEKDTFVKLELLNGYLHLSVQVKNQPRALLHISHNVSDGEWHSVEVTLARAVTLNLLDSSCAESCVNKTSAMIDNDHVRLAFQSTFLGSLPVGNISSSSQLNINNIHSTPSFVGCLQDIEIDLNVITPENASPESSLNVEAGCRKKDWCENHPCQNRGRCSNLWLSYHCDCYRPYAGPSCAAEYIPGRFGSEDSSGYAAFSVDATENENLNISMFVRTRKSSGLLLALRNSTSLYVRVYLEGGKLAMLAPNSIKLLGKHPINDGNFYLITLKIEPNMLELFQSSQYLGFISTPVLTTQSKDFLYVGGLPDNRETDRNGGYFKGCIQDVRVNNQPLEFFSLTNSLNSFINRTLINVTQGCSGDNLCKSSPCHNGGVCYSIWDDFTCTCPPNTAGKACEEVKWCELGPCPHEAQCKLAHQGFECLANAVFSGRSSAIFYRSNGNIGRGLTNIVFGFRTRDKNVILLYAEKEPEFVIISIHNSKLVFQLQSGNNFYMLTLTSSLTVSDGKWHQVTVSMVEPLSQFSRWHMNIDNKDAATSTTATGSLNFLREETDIHLADKAFDNLDGLRGCMSTIEISGIYLSYFENADILTKKPQEEQFLKISANPVLTGCLQEDACSSEPCMHEGTCEDLYTSYRCTCRPGWVGTHCETNIDECFSNPCIHGNCTDGINSYECICEPGYTGLNCEEDIDYCQGHQCANGATCIDGINGYSCLCAGNFTGKLCRYRRLPYTVCGNEDRNLTCYNYGNCTDLGGKLACVCLPGFAGERCEKDIDECSSDPCLNGGLCQNLLNKFHCLCDVNYAGDRCEIDLTTDLISNVFTSLGSVTLALLILFLAVVVSVIAANKRSTQGTYSPSRQEKDGARVEMWSMVQPPPIERLI

SEQ ID NO: 28 - protein, 1380 aa, Taeniopygia guttata
  MISC_FEATURE: Taeniopygia guttata CRB1 isoform 1
SLCTRNDSRCLSNSCQKNSTCVAGHKDDPCLCADASVDSVEELCNKTSNPCSSNPCLQNATCLGSAGNLSFTCKCPAGYNGPSCETADSDCDTNPCEHGGTCQSGLAGPTCLCSAGYTGALCERDVDECISEPCRNGALCRDGVDEYSCYCVPGYQGKHCDLEVNECASEPCLNGATCLNQIGHYVCICPLGYTGTNCEVEIDECLSQPCLNGGTCHDSLGSFSCSCARGFLGDRCGTDIDECSSQPCLHGAPCMDGANGYSCNCTGTGFMGSHCETLIPLCWSQPCYNNATCEDHADNYTCHCWPGYAGSRCEEDIAECRSSPCLSGGHCVERSWAGLYGLVPGLPPPFRYDRAEGYVCRCPPGFAGTHCDEDVNECYTNPCQNGGICENFPGNYTCHCPPADKEGIFYGGWNCTEVLHGCTDHQCQNNGICIPHLKNGQHGFSCICPPGYTGIHCETITTFSFQGNSFLLLKNSQTHKKEFFNINLRFQTVQPTAFLFHRGEKNTFAKLELLNGYLHLSVQVNNQPQALLHIPHNVSDGEWHSVEVTLARAVILNLLDSSCVESCLNKTSAKIDNEPVMFAFQSTYLGGLPVGNSNPLQNTFNTHSAPSFVGCLQDVEIDLNVITPENVSSGSSLNVRTGCAKKDWCDPHPCQNRGRCINLWLSYHCDCYRPYTGPDCAAEYIPGRFGSEDSSGYAAFPVGSTQNENFIISMFVRTRKPSGLLLALRNSTYLYIRVYLEGGKLTMLALNSMKLLGKHSVNDGNFYLITLKIEPNKMELFQSSHYLGFISTPALTIQNKDTLYIGGLPDSKETDRNGRYFKGCIQDVRVNNQPLEFFPITNPPNSLINRTLINVTQGCTGDNLCKSSPCHNGGVCYSIWDDFTCTCPPNTVGKACEEVKWCELGPCPHEAQCKLVHQGFECLANAVFSGRSSAIFYRSNGKISRDLTNIVFGFRTRDTDVILLYAEREPEFVIISIHNSKLLFQLQSGNSFYRLTLASSVPVSDGKWHRVMVSMVEPLSQSSRWYMDIDSKRDTSTSTAAAGSLNFLREETDIYVADKAFDSLDGLRGCMSTIEISGIYLSYFENADIPTKKPQEEQFLKISANPALTGCLEVDFCSSDPCMHGGICEDFYTSYRCVCPVGWTGTYCEVNIDECSSNPCIHGNCTDGIASYECSCEPGYTGENCEEDIDDCHGHQCVNGATCVDGINGYSCLCAANFTGRFCRYRRLPYTVCGNEERNLTCFNYGNCTDLGGELSCTCLPGFVGERCEKDIDECSSDPCLNGGLCQNLLNKFHCLCDVNFAGDRCEIDLAAELMSSAFAAVGAVTLALLALLALAVALSAVTASKRATQGTYSPSRQEKEGSRVEMWNMVQPPPMERLI

SEQ ID NO: 29 - protein, 1396 aa, Meleagris gallopavo
  MISC_FEATURE: Meleagris gallopavo CRB1 isoform 1
FTPSTGEVLRTFFLSFLESLSMRNDSRCLPNSCQKNSTCITGHRDDICRCVDMSLEEHLEELCNKTSDPCSSNPCLQNATCLSSAGNLNFTCECPDGYNGTTCEISISMCDPNPCEHGGTCLDGLARPTCLCSTGFTGTRCEMDVDECSSEPCHNGAVCRDGIDEYSCYCVPGYQGKHCDLEVNECVSDPCLNGATCLNLIGRYYCICPLGYTAIDCQLGSSSCWSCPAFITKFCRFPASSHFPKMLKRECASGSDEIGTTDYIHSSYLVIRKNRYSCNCTGTGFMGLHCETHVPPCWSQPCYNNATCEDSADGVTCHCWPGYTLPGFFCSLSCSLTSSVLCETAGEHEELSSSKQYWPIFRYSDFFSYHKTSRYVTLCGFTSIHCDEDINECHMNPCQNGGICENFPGNYTCHCPPADKEGIFYGGWNCTEILHGCTDQQCQNNGICIPHLKNGHHGFSCICSPGYTGIHCETVTTFSFQGNGFLWLKNPTTTEEEFSYNINLRFQTVQPSAFLFYRGEKDTFVKLELLNGYLHLSVQVKNQPRALLHISHNVSDGEWHSVEVTLARAVTLNLLDSSCTESCVNKTSAMIDNDHVRLAFQSTFLGSLPVGNISSSSQLNINNIHSTPSFVGCLQDIEIDLNVITPENASPESSLNVETGCRKKDWCENHPCQNRGRCSNLWLSYHCDCYRPYAGPSCRAEYIPGRFGSEDSSGYAAFSVDATENENLNISMFVRTRKSSGLLLALRNSTCLHVRVYLEDGKLTMLAPNSMKLLGKHPINDGNFHLITLKIEPNMLELFQSSQYLGFISTPVLTTQSKNFLYIGGLPDNRETDRNGGYFKGCIQDVRVKNQPLEFFPLTNSLNSFINRTLINVSQGCSGDNLCKSSPCHNGGVCYSIWDDFTCTCPPNTAGKACEEVKWCELGPCPHEAQCKLVHPGFECLTNAVFSGRSSAIFYRSNGKISRGLTNIMFGFRTRDTNVILLYAEKEPEFVIISIHNSKLVFQLQSGNNFYMLTLTSSLTVSDGKWHQVMVSMLEPLSQFSKWHMNIDNKDTATSTTATGSLNFLREETDIHVADKAFDNLDGLRGCMSTIEISGIYLSYFENADVLTKKPQEEQFLKISANPVLTGCLQEDACSSEPCMHEGTCEDLYTSYRCMCPPGWAGTHCETNIDECSSNPCIHGNCTDGISSYECVCDPGYTGLNCEEDIDYCRGHQCANGATCIDGINGYSCLCAGNFTGKLCRYRRLPYTVCGNEDRNLTCYNYGNCTDLGGKLACVCLPGFVGERCEKDIDECSSDPCLNGGLCQNLLNKFHCLCDVNYAGDRCEIDLTTDLISNVFTSLGSVTLALLILLLAVVVSVIAANKRSTQGTYSPSRQEKDGARVEMWSMVQPPPIERLI

SEQ ID NO: 30 - protein, 1428 aa, Danio rerio
  MISC_FEATURE: Danio rerio CRB1
MDMDLAVWGSVWLRLVACVLFVLLQWTESVTLLKTSTLCLDNPCQHQSECREALSDFLCQCQTTVPVFPSTRCDSSSTLCQLSICQGNATCQPTGAHPGELVCQCDSGLLGQDCLSSAQLCAQGHCGDSAHCLAVRDQSPGYACICQEGYTGRSCEKEVDHCSPNPCRNRAICRSRRNGPTCFCVPGFQGQLCEIEVNECVSRPCRNGATCVDKIGHYICLCRPGYMGSSCELEIDECQSQPCLHGASCHDHINGFTCTCLAGFQGESCEINIDECRDQPCQNGALCVDEINSYRCDCSQTANFTGVDCEIPPPPCWSQPCLNSALCEDQQENYTCNCWPGFEGRNCEVDVSECESSPCVNEGICMELSWKTLYGTEPLFTARYNPRLASGFICKCPPGFSGALCEQNTTACTTSPCHNGATCEDFLGSYKCICPSESEDGVLYGGRNCSEPLTGCEGHECQNGASCIPFLSEGVHGYSCICQPGYTGSYCQTLTVFSFETSRAFLHLQTPLLGAETYFNITLSFRTVLENTVLFQRGSGGVTLSLEIQETHLILDLKTDPQPNATSWTLMLPQVVSDGEWHTVEAVLGEGTLLLQLLEPCQGGQNCGTTAQVKIGALELESALLSTFVGGLDEGGSSRSFIGCMRDLLVDSQLMIPEDWLSSSAVNVVQGCSHHDRCLSGPCENHGECVNLWQGYQCKCLRPYVGQNCDEEYITTRFGQEDSTSYAVFTINDEPDSETLHLSMFLRTRKDSGLLVLLANSTSDYLQMWLEKGKLTVQVNNLKTVTGERVLNDGERHFVSVTIEDGMMTLQNSDHEFEATYVQPVSIQFGDTINVGGLFDVQALTAFGGHFKGCLQDLQLNEKKLEFFPIDTSAMSYKPDRVVEVTAGCTSDDTCSKNPCQNGGICFSSWDDFTCNCPPNTSGQHCEEVSWCDLNPCPPQAICKALNQGYECISNVTFQENTTLVYQGNGLISRHLTSIVFNIRTRKRNAIVLHAESGSEFVTVSLQDGFLVLELLSGPTTSSSLSPVTLHSPRVVADGEWHVIELLMATPGSNSSHWIMVPLDEKDEPTKSDSMTGNLDFLRESVYIMLGGLGPDSGSNLIGCLSNVEIGGIVLPYYGQTEVRFPRTQEEMFNKISEEPVQTGCFGEVVCEPNPCLHGGICDDHFNLFHCFCLPGWGGDHCELNTNTCASNPCRHGYCSVQDLTYNCTCEDGYTGTNCEMKVDACAGHRCANGATCLRGFNMYSCLCTDKFTGPLCNIQIEEVPWYVVVRNIPPKLPVSICGDEQQNYTCFNGGNCSDTNMPCDCHPGFSGHWCELELDECRSNPCKNGGYCQNMVNRFQCVCEMTFAGETCEVDLNAESVTSQLLLSISLVCVVLLLVVFGVTTALVIALNRRATRGTYSPSRQEKEGSRVEMWNIVQPPPMERLI

SEQ ID NO: 31 - protein, 1282 aa, Takifugu rubripes
  MISC_FEATURE: Takifugu rubripes CRB1
CSPNPCQNKAICRPRGGGYSCFCVPGFQGGRCQIDVNECASQPCRNGATCEDRVGTFSCLCSPGFTGATCEIQIDECQSQPCLNGARCHDYTDGFACICPSGFQGHKCEFNTDECQEQPCKNGAPCVDGVNGYSCDCSHTAFTGTHCETPRPPCHSGPCLNSATCQDHQGNYTCVCWPGFEGRHCEIDINECGSSPCMHGGRCVERSWQTLYGTEPLLPQRYDRQRAAGYICSCPPGTTGSLCQEVINLCDPDPCQNGGRCEGHVGGYTCHCLKHSGHGVLYGGQNCDERLVGCDGHACQNQGSCIPSLLDGSHGYTCSCSPGYTGLLCATPTTFSFERRGYLLLRSPLAGARPHYNITLSFRSVLPRAMLFRRNSRGSLLSLELDEGRLRLTLRRNASAGAEADGLSQVLELPHNVTDGDWHSVETVLRNRVLSLKLLDDSVSCARQPCHKAIPVQSAPVSLASPPHNTFIGGVLQPRVGPSEEDPVPSFIGCMRDVFVDRQLVVPEEWPKNSAVNVSSGCNHRDRCLDVPCKNGGQCVNLWQSYRCRCPRPYEGQDCEEEHVTARFGDGDSHSYAVFTVSRDMGRDFAVSLFLRTRRLDGFVLALDNGSSRYLHMWLEDGRVAVQLGSLEILKSKSPINDGGVHFVSLEIEASRMMLRVAAQKQGEVEVGTVGVEAGHSVYVGGLTGSRMTSVFGGYLKGCVQDLRVNDRRLQFFRLHASVNSFPLKLMENVTAGCSGDDGCRRKPCLYGGTCFSAWDDFTCACPPKTAGRRCEEVRWCELSPCPADSECRVLNQGYECYSNATFLNDSTVLTYRGNGQISRNLTSLSLNLRTRKRNVAVLHAESGSAFITLSVQDGFLFLELQSTAEEGRDEAGAVSTISLSSRSGVSDGEWHSVQLFMATPWAPTSRWTLVLDEKIEEASVSRTKGGNLDFLREEVDIFLGGLAPDAGWSLSGCLSTVELGGIALPYLGPSEVNLTRSQEEQFVQTSPRPPLLGCSGAPVCDSNPCLNGAECQDLFNAFDCSCVDGWSGRRCDFFTDTCASGPCVHGNCSVRGLTYECACDFGFAGVDCNEKVDVCETHRCANGGTCLHGPDRYACLCPENFTGPLCNERIEEIPWYIVLRKVRPKLPVSVCGDETRNYTCFNGGNCTDRELSCDCPPGFTGHRCEQELDECKSNPCQNGGYCHNLINKFVCVCDMSYAGDVCQTDLTSEGLTSDLLLSVSLVSVLLLVALVLTSVGLAAALGRRATHGTYSPSRQEKEGSRVEMWSITQTPPRERLI

SEQ ID NO: 32 - protein, 1410 aa, Pelodiscus sinensis
  MISC_FEATURE: Pelodiscus sinensis CRB1
ALNTILYLYLITLYLQFSSMCCLIKNRLGVRNDSRCLSKSCQKNSTCDAATKDNSCRCVDTIDILEEDCNKTDDPCSSNPCLQNATCLSMAGNLSFTCECPTGYSGTTCEFPISLCDTSPCRNGGTCQQGLAGPICVCSTGYTGNLCETYFNVCTSNPCHNGALCREGIDGYSCYCVPGYQGKHCNIEVNECVSDPCLNGATCLNQIGKYDCICPAEYTGVNCELEIDECLSQPCLNGATCHDTLGSYFCSCALGFQGELCEINIDECASHPCLNGGQCIDDVNRYSCNCTSSGFTGLQCEILIPLCQSEPCHNNATCVDNAGNYICSCWPGYAGSHCEIDVNECNSNPCSYESECVERSWTSWYGRIPELPEEFSYHRASGYVCNCRPGFTGIHCEEDINECSMNPCQNGGTCENFHGSYTCHCPFGEKEGTSYGGKNCSEALIGCNDHPCQNSSLCIPYLKNGHHGASCMCPPGYTGIHCETATTFSLAGHGFLWVKSDMTPLQGSFYTINLRFQTVQPTAFIFHRGEKDTFVKLELLNGYLHLFMQVNNQPRALLHISHNVSDGEWHSVEVTLARAVTLNLLDSSCVESCVNKSTTAIDSDQLMLAFQSTFLGGLPVGSMSSDFSPNTYNMHSAPSFVGCLQDIAIDLNVITPENISSETSLHVKAGCKKKDWCENHPCQNRGRCINLWLSYQCDCYRPYTGPNCSTGYVFTTSRFGHEDYSGYAAFSVDSSQKENITISMFVRTRKSSGLLLALRNRTSLYIRIWLEDGKLIMLASNATKLLGTRTVSDGIFYLISLKMEKNKVELFLSSQQLGYISTPILTVQNRDIIYVGGLPDKQETDINGGYFKGCIQDVRLNNQHLEFFPITTSLYSVINRTLINVTQGCTGDNFCKSNPCHNGGICYSIWDDFTCTCPPNTAGKACEEVKWCELSPCPQEAQCQLVHQGFECIANAVFSGRSSAIFYRTNGKIRRDLTSIVFGFRTRDADVILLYAEKEPEFVTISIQNTKLVFQLQSGNSFYVLTLASSQPVNDGKWHQVILSMTEPFSQSSRWQIDIDDKKDTATSTVATGSLNFLREEIDIYVADKAFDNLDGLRGCMSTIEISGIYLSYFENYDGHAKKPQEEQFLKISANSVMTGCLQLDACSSDPCMHDGICEDLYSYYRCACLKGWTGTHCETNIDECFSNPCIHGNCSDKTAAYECLCDPGYTGVNCEENIDNCRGHLCANGATCVDGVNTYSCLCAGNFTGKFCRRTKLPFAVCGNEKRNLTCYNYGNCTELKGELRCLCLSGFSGERCEMDIDECNSDPCMNGGLCQNLLNKYQCICDVNYAGDRCEIDLTADLISNIFTAIGSVTLALLLILFLAVVISVIAANKRATQGTYSPSRQEKEGSRVEMWNMVQPPPMERLI

SEQ ID NO: 33 - protein, 1406 aa, Monodelphis domestica
  MISC_FEATURE: Monodelphis domestica CRB1
MALSRINSLLIFCLNLLLLLHVKKSFCIGNDTECFSNPCPNNSTCDDAGKDSTCHCSGTTENVGEDCIKKLVSCSSKPCKRNGFCFDLDEEPGFLCRCPPGYGGKHCEITFTSCVSGFCRHGGICHEGTSGPFCDCPDGFIGKHCETDFNECASNPCRNGAVCQDGINGYSCFCVPGFQGRYCDREVDECVSNPCYNGAKCHNKVGSYICDCLPEYFGTNCEFEIDQCLSQPCLNGGTCQDSVGRYFCDCASGFRGEHCEINTNECLSQPCLNQGKCTDGYNSYSCNCDDTGFTGTHCEISLSVCSSKPCHNNGTCEEFDDTFICHCWPGFTGSQCEIDINECSSNPCLSTGECVERSWASHYGKIPELPSEFNYLQATGYVCHCQPGYTGSRCEDDIDECSSNPCRNGGMCENIPGNYTCHCPPKDYQGIVYGGVDCREIFLGCTQDKCQNNGICIPYVQNGQHEFSCLCPSGYSGSLCDIMTTLSFEGNSFLWITSTPGPIKDSLSNIALSFQTVQPSALLLLRGDKDTHVKLELWNGYVSLSIQANNQSKVLLHISHNVSDGEWHSVEVTLAEAVTLTLRDDSCVEKCVNKTPSPIERDQVMIAFQNTFLGGLPVGKTNDGATLLNIYNMHSAPSFVGCLQDIEIDLNLITSENISSGSSFNVKAGCDRKYWCENHPCQNRGRCVNLWLSYQCDCYRPYEGLNCLREYTPGRFGQDDSTGYALFRLDNNPEEIVTLSMFVRTRRSFGFLLALRNSTFQYLSVWLEHGRLAVLAPSSPKLLGRSLLNDGNIHLISLKIIPNKIELYQSSQNLGSLSTSTWKIQTGDILYIGGLPDKKGTEVWGGYFKGCIQDIRLNSQKLEFFPITKGNSTLNQTLVNVTPGCTGDNLCKYNPCHNGGVCYSIWDDFTCSCPPNTAGKACEEVKWCELSPCPPEFQCQLVSKGFECIASAVFSGRESAIFFRSNGKITRELTNITFGFRTRDSDVILLYAEKEPEFITISIQNSRLIFQLQSGNSFYMLSLKSMQPVSDGMWHQVFLSMIEPLAQSSRWRMEVDDQTTIVTSAVATGNLNFLREETNIYLGDKPFDNLDGLRGCLSSIEIGGIYLSYFENADGHTKKPQDEQFLKISTNSVVTGCLQVDACNSDPCWHDGDCEDFYNSYGCVCPIGWTGAHCEINIDECFSKPCVYGNCSDRIAGYTCKCNPGYTGVNCETNIDDCENHRCANGATCIDGINGYSCLCFGNYTGKLCRQTRLPMTVCGNERRNLTCYNHSNCTELQGDLKCVCRPGFTGEWCEKDINECDSDPCLNGGLCQNLLNTFQCNCDGNFAGERCELDLTDNLISDIFTAIGSITLAVLLILFLAVVASFIASNKRANQGTYSPSRQEKEGSRVEMWNMVQPPPMERLI

SEQ ID NO: 34 - protein, 1408 aa, Canis familiaris
  MISC_FEATURE: Canis familiaris CRB1
IVIKQVNQVVTFTLHLGIFYFLVDSFCNKNDTRCLSNSCPNNSTCDDSSKDNNCHCSDAAIHVDKDCDNMRNPCFSNPCQGNATCVNNPGERSFLCKCPPGFSGTTCETAIVYCGINPCQHGGICHQDPVHPICVCPDGYFGRFCENDLDECASSPCHNGAMCQDGINGYSCFCVPGYQGRLCDLEVDECVSDPCKNEATCLNEIGRYTCICPRDYSGVNCEVEVDECQSQPCRNGATCRDALEAYFCDCSPGFLGYDCELNADECASQPCLHGGLCVDGYNSYSCNCTGSGFTGTHCETLMPLCWSEPCHNNATCEDSADNYTCHCWPGYTGAQCETYINECNGNPCQSGGTCIELSPEKPYGHLAQLPSSFSDPEASGYVCICPPGLTGIHCEEDIDECSSNPCQNGGTCENLSGHYTCRCPFDNHSGTFYGGKNCSDVLLGCTRHQCLNNGMCIPHFQNGQHGFSCLCPSGYTGPLCELVTTLSFEGNGFLWITSGPATGKGLVCNMALSFLTVQPMALLLFRGNRAMFIMLELRGGYIHLSIQVNNQSKVLLYISHDTSDGAWHSVEVTFAEAVTLTLLDNTCKEKCITQAPSPFESHRSICAFQNSFLGGLPGGMTSYGIALLNIYNLPSTPSFVGCLQDVKIDSNHITLEDISSSSSLNVKAGCERKDWCERQPCQNRGRCINLWLNYQCDCYRPYEGPNCLRDTEEYVAGRFGQDDSTGFAAFNLDKSYEENVTISMFVRTHRPSGLLLALENKTYQYICVWLEHGRLAMLHPGSSKLVAKFVLSDGNVHLISLKIQPNKIELYQSSQNLGFISAPTWKIQKGDVIYIGGLPERSQTEAKGGFFKGCIQDIRFNNQNLEFFPNSISNASHNPTLVNVTQGCSGDNMCKSNPCHNGGVCYSLWDDFSCSCPANTAGKACEQVQWCELSPCPPGAQCQAVPRGFECIANAVFNAQSSEILFRSNGNITRELTNITLGFRTRDANVIILHAKKEPEFLNISIRDSRLLFQLQSGNSFYMLSLTSLQSVNDGIWHQVTLSMTDPLAQASRWQMEVDNQAPSVTSAVATGSLNFLKDNTDIYVGDRAIDNSQGLKGCLSTIEISGIYLSYFNVHGFTNKPQEEQFLKISMNSVVSGCLQLNACNSSPCLHGGNCEDIYSSYHCSCPLGWSGTHCELNIDECFSNPCIHGNCSDRVAAYRCRCEPGYTGVNCETDIDNCQNHQCANGATCISDPSGYSCHCSGNFTGKFCRHTRLSSTVCGNEKTNLTCYNGGNCSEFQGELKCLCRPGFTGERCDEAADECASAPCAHGGLCRGLGRGFQCVCPAAFAGERCEVHLADDLISDVFTTIGSVTTVLLLILFLAVVASVVASNKRATQGTYSPSRQEKEGSRVEMWSMRPPPALERLI

SEQ ID NO: 35 - protein, 1406 aa, Oryctolagus cuniculus
  MISC_FEATURE: Oryctolagus cuniculus CRB1
LKTRLSHFLYFFFFSFSLVELLKNSFCNENVTRCLSNSCPNNSTCKSFPQDSCPCSDVTDSLDKDCDDVKDPCSSNPCQGSATCLTTPGGRGFLCRCPPGYSGTTCETSTGSCGVSSCQNGGICHQGPVQPTCICPAGYAGRFCETDEDECASSPCHNGAMCQDGVDGYSCFCVPGYQGKHCDLEVDECASGPCKNEAMCLNEIGRYVCICPHDYSEGVNCELEIDECWSQPCLNGATCRDALGTYFCDCAPGFQGDSCELNVDECASQPCLHGGLCMDGGNSYTCNCMGSGYTGTHCETLLPLCWSKPCHNNATCEDNVDNYICHCWPGYTGAQCETDVNECSSNPCRPTGDCVELSSEQQYGRVAGLPSSFSYGEAAGYVCACHSGFTGIHCEEDIDECSSNPCQNGGTCENLPGNYICRCPFDNLSGIFYGGENCSDVLLGCAHHHCRNNGICIPHFQDGQHGFSCLCPSGYTGSLCEIITTFSFEGNGFLWVTSGSDPPVDSVCTIALRFQTVQPTTLLLLRGHRDVFVKLALLKGYVHLLVQVRNQSKVLLYIPHNTSDGEWHPVEATFAEDVTLILKDSSCKDECIATAPSPFLSHQSICASHDSFLGGFPVGATNRTIALLNISDIPPTPSFVGCLQDIKIDLHHITLENIAQGSSPNVQAGCVRKDWCENQPCQNRGHCTNLWLSYQCDCYRPYTGPDCLREYVAGRFGQDDSTGYAVFNLDESPGENFSISMFIRTHRPSGLILALENSTYQYIRVWLEHGRLAMLTPNSPKLVVKFVLSDGNVHLISLKIQPNKIELYQSSQNLAFISTPTWKIQRGDVIYIGGLPSRQETEVSGGFFKGCIQDIRLNHQNLEFFPNSMNNTSRNPILVNVTQGCSGDNICKSKPCHNGGICYPLWDDFSCSCPAHTTGKACEQVHWCLLSPCAPAAQCQVVPQGFECIANAVFSEQSGEILFKSNGNISRELTNITFGFRTRDANVQILHAEKEPEFLNVSIQDSRLFFQLQSGNSIDLLSLTSVQPVNDGTWHQVTLSMANPLAQASRWHMEVDNQAPFATSSIATGNLNFLKDDTDIRVGGPAIDSMKGMQGCLSTIEIGGIYLSYFENGQGFPPKPQKEQFLKISRNPVATGCLQLNACNPNPCLHGGNCEDVYYSYHCYCPLGWSGTHCELNVDECFSSPCIHGNCSDQLAAYHCRCEPGYTGVNCEVHIDNCQGHQCANGATCISETDGYSCQCSENFTGKFCRHSRLPSVVCGNEKTNHTCYNGGNCTELQAEFKCTCRPGFTGEWCEKDIDECASDPCFHGGLCRDLHGRFQCICDVAFAGERCELDLADGLISDMFTAVGSVTFALLLILLLAALASVVASSRRATRGTYSPSRQEKDSSRVEMWCRTAPPSIERLI

SEQ ID NO: 36 - protein, 1722 aa, Caenorhabditis elegans
  MISC_FEATURE: Caenorhabditis elegans CRB1
MKYQHFLIFCTLVTNALCNRACSRNTCLNGGTCTVNDETRMFQCECPKGFSGLLCQDNCSLHCLHGNCVKGTFGEETCQCSEGWMGSLCDNLVTDDDTAQKCSPQCGDDERCTKGADGSYICQSNEPSCATHTCQNNGTCVAENGNVKCACPPGFVGDHCETDEDECKENFCQNGADCENLKGSYECKCLKGFSGKYCEIQDKKQCTSDYCHNNGQCISTGSDLSCKCSPGFDGAFCELKAEVNECICENPAHVCSLVNGTSRTTQCECPSGFMGADCKELQARPCDREPCLNGGHCVDDGQNLFTCFCLPSFTGIYCGEPVDCLVNGSDCKNGGKCVFALAATTCQCPEGFNGSNCEISNSYRSHPTCSDIRCLNGGSCKLDAEGEPFCVCEEGFDGPFCEPKSGCTINPCQNGGTCQDADGQYFCHCTSGFGGVHCETVDEPSTPIPTLGTFPSFTTSGIDGFSQSKISCEDCVNSSNCLDVESGPVCICDDGYFGQKCDQKHDKCSKVSCPSGQTCSQVNDNVNITAQCGCEIGHFGQQCEMVTSATFSAKSLYIHQSSKFSLGTSSFENIAYELEFSFRTTVENTHLASSENILGEKILSIQLLSGYLVFNMTGNSLEHLLPMRVSDAQWYTVFVKGEDNKIQIEVSTENGFSLVQKSVNGQLEVFLTRFGKISGTHHFIGCMADVRVDGDLIIFADNKRAIDIRKGCTRSEQCTRAYCQNEGICIDHWESSSCKCKPPYLKPNCVYFLPKTTFGHLDQPSIVHLSTSESENHLLRNHIELSFLMHSGKPDAVLFYIGEKHAADVLTNYLVVKIAGGLITVRYRTGGRREIEFSSKNRVDDNQEHHVQIFLDKTTRQIIIDDLIECSEPIISRMSQEFYVDDIVIGASNVVATDSEFYKGYLQDIQINQKSVVIHPTSLTIDKIGKLERTQNVIEGAVSDPMCSSSTCKHGECSETFNDFTCRCSDGSTGKLCDKVDYCKDASCMKGSRCENADNGHYCIFPITISNGSMLTYSLAPTKFMTLPSIEFSIKAHSQNGHIFTLTIDKSTLSAYLFKKRLALATNSGSGTIQKFDSVIADGNWHQIILNPHKVLIDSVKFISDNQLYPAESKSGASLFVGEQEPQEVTFACLDLFKMGEYPTLSFTKVKIPTNSETWNLTDKASVGTGCMSTDQCGLYSTCLNGATCVDIWNKRKCVCPAGFAGENCEDNVNDCKFVDCGKHGYCLDGIDEAKCICNNGFHGEHCELAKDECEGVECHNGGKCVKNRSEKIVCQCGNSWMGDSCNVTKTTNCKDSPCQNFGQCMQKTDTFFECNCMDGYSGELCEQRDVNECNHYDCNRGHCVMTVSGPACQCEMGYTGRFCEKLLNQCSSNTCSSRGACSPVWNNTVCNCDNNWRGAHCQHQMDTCLDFPCNNDGVCRTNDENTFSCECQKFFMGTRCEIEGSCLKAQCVHGECIQLSPETHTCSCNIGYEGDACDKKIDYCKAGPCLNGANCENKLTGYKCTCAVGFEGADCEINIDECALEFCKNGAKCRDKINDYECVCDGTGFEGRNCTTDINECANPNNCINGECTNTLGNYKCACRNGFIGPRCSVRNPCTAQIASNNISSVTCVHGKCVNPVVQIEKNREVAKYECACDRGYTGPTCSQRIKESAMSNISYLFGPIIAVVIVFAILGCLLLFFVIRGNNAMHGHYSPSSHEFTQNRMAMPTVIKLPPQERLI

SEQ ID NO: 37 - protein, 1377 aa, Xenopus tropicalis
LCIHNIAYVLVPFLNFVLLFIFKVTLCVDIEAQCSSPQCNGNLSCSSTEDCIGTKDPCLSNPCSRNAKCQVISFVTQTYVCQCPVGFTGEKCDIHLKRCSRNPCGNGGECYVGIDGFICTCTAGYKGKLCETPEDECLWNPCQNGAVCRNRRDEYACYCVPGFQGPLCDIEVDECISQPCHHGAICLNQIGKYTCMCPPQYTGRDCELEADECASQPCLNGATCHDFIGSFNCTCPPGFEGDLCQFNIDECASYPCLNGGLCIDGDNGYTCECNMVGFIGMHCEMPVSMCEYKPCHNNATCLEGSAKFTCLCLPGYTGSLCEMDISECSSQPCQFDSECVELARPAMGTYNEHAGYICKCRKGLTGVHCETDINECESKPCQNGGTCENLHGGYTCHCKTHADVAGKYYGGRDCKELLFSCASHRCHNGGTCIPQLKEGEHSHYCLCPEGYAGPSCQAQTTFSFNGKSVLPIHRNRSQTRGDHLFNISLSFQTVQTSAVIFHMGAQNTSVRLYLQNSYIHLASEVNCQINSLLHLPHNVSDDRWHAVAVTLTDVLTLTLLDAQCNIRCTVNSDHIISTHLRDSVFQQMLLGGEPAVRTAAENNNDANNAEEMQAWFVGCLRDFRIDSAFVTDESVTVGDIDVGCKRRNQCERQPCQNRGRCINLWLGYRCDCFRPYRGRNCSSEYESGRFGQRQQTSYAAFQVDIDQSEEITISAFFRTRHRSGILLSLGNSTNYHSVISLDGGIVTMKTISNVLLKANYTINNGNFHLVSLKLAQTKMEMFVSLKSVGQIDMGLTGVHSTSVLYVGGLADAKETTKHGGYFMGCVQDLRIAETHLKFFPSSESSTVGNITVSNVTRGCKSDSECNPSTCHNGGICYPVWDDFVCSCPPNTTGKACEDLMWCQLTQCPPGSVCQTVPSGYECTTSVVFNGTSHGVMYRSNGKIARDLTNVTLQFRTQASESILLYAEQEPDILTIAIQRSRLLFHLQSGNSLDAVSLYGAELVNDNQWHNITLSMTTPESHSSHWQMALDGKMDIISLFPTGNLNFLREGTDIYLGINGKDGNLHFLGCLGMVQIGGIYLSYFGDDDYQVTRPQKEQFIRVSAVSVGIDCLSSESCVSQHCMHGDNCRGGFTHPICTCPPGRTGAFCETYTNKCHSSPCLHGNCTDTITGYLCKCQVGYSGINCDIHNCQDHQCATGATCIGQAYGYSCLCPANVTGVLCRYNRLPSTICGNGKKNITCYNRSNCTEERGELGCACLPGFVGERCEIDVDECESNPCLNGGLCQNLPNRFHCICDLNFAGEHCEIDLSDFLPPGVFTAVASVVLALFFIVCAGLCIFIAISGMRSSQGAYSPSRQEKESSRVEMWNIVQPPPLERLI

SEQ ID NO: 38 - protein, 778 aa, Xenopus tropicalis
  MISC_FEATURE: Xenopus tropicalis secretory protein CRB1 isoform 2
MDPRRKSGSLASAVLQFLLFSFAKGLAQTCMSSPCLNGGTCLETSTGFTCLCPMQPLAFTGPTCGDIYDACAVYGCPSTHRCQSTPGLPHFQCVCQPGFNCTNECQSNSCPFLNSHCTVGEDSIMCKCQSGYGGVNCQYEVSPCFQNTCQNNATCLADAESYRCLCEPGFTGQDCEVNINECASDPCQNEALCVDKVNRYMCFCVPGFQGHHCEIDINECASRPCQNNGTCLNQLDQYECACANANTGVNCEIEIDECQSGPCQNGATCWDHIGYFTCDCPAGYDGELCQQDIDECQSQPCQNGGRCVDEINRFQCDCSHTGFVGDHCEIEILECDSNPCQNNATCVERVKGYECLCWRGYSGIHCETDDNECTEKPCENGGLCLQLSNQSYYGTEPEFGDKFSYSQAAGYLCRCQPGFTGSNCSVNINECESGPCVNGGTCIDLINGFLCSCVSGYTGVGCSINIDECEDNPCKNGASCEDGVADYFCVCRPEAQDGTIWGGKNCSVKLVGCLEHSCQNRAECIPLYNEEKHSYTCKCQPGFAGENCSIPTTFSFLAQGYIMYDLLLSNESYLSNVSVRFRTTLPDMVLMYRGDEDSFLILEPYNGFLYIRLKGNGRLFQLVIDNHKVNDGYWHNVEVDIISNSFLKFRLFHNGCRNGLCSRKQPLTEGFNPYLPESFSLVYIGGLVQEALIKNTLSQQNFTGCLEDLVVDLFPQLPHNVSSDRSFGMEPGCRKVELCHPNPCHNGANCIDLWSNFTCDCIRPYKGPTCMQGKCLYL

SEQ ID NO: 39 - protein, 1606 aa, Anolis carolinensis
  MISC_FEATURE: Anolis carolinensis CRB1
MPLSKSQAESRNPKRKPTGSSNAVIKSQAEFRNEQGSKPEVMMPSSGAKFRNQQEANKRQARSEQRRCQEPSRIQKPKRKPANTKPRTSVVVVRSQNQTQESKGSQEQALSSTGANTELRSHREARNERCRRQEPKPNSGAKGKPGTPNQEQTLSSSGAKPDSGTRSLIGIKTISVFVIIPRLSALLLVHIACGCLVVCCKLLSAYILRNRRGPPKKSLCEKDGPRCLSNSCQNVSECSGAPAAAKGTGCHCPDVLLDGISAEDCVQTSKDPCASSPCLHNATCSSAAGNLSFTCNCLMGYTGDTCETTISTCDLHFCRHGGTCLESPDGLVCHCAEGYMGAYCETNLDECLSNPCLNGAVCKDRINGYACYCVPGYQGKHCDLEVNECVSDPCLNGATCLNLIGKYYCLCPLEYTGINCELEIDECLSQSCLHGGTCHDSLGGYYCSCPVGFLGELCAVNADECASQPCLNGGQCIDDINGYTCNCTESGYMGLHCEMLIPFCWSNPCYNNATCQDTVESYICHCWAGFTGSHCEVDINECHSNPCRHGSECVELSWSSWYGKIPDLPSEFSYHTASGYMCHCPLGFTGIHCEEDINECHMNPCQNGGTCENSLGNYTCHCPAIEENGIFYGGWNCTEVLLGCVQNTCQNEGLCIPHLRNGQHRFSCLCSAGYTGVHCETMTTLSFQGNGFLQVNSLPSAIQDCFYNTNLQFLTVQPTACIFFRGDKDVFVKLEILNGYLHLSIQINNQSKAILHVAHNVSDGEWHLVEVTIARKVTLKLLDKFCTDSCLSESETPIDCQQTTFAFQSTFLGGLPKGNRSNDFLPSISNMHPAPPFVGCLQDIEIDLNLIIPENISSDSSLNVEAGCTKRDWCEHHPCQNKGRCINLWLSYQCDCYRPYTGPSCATEYIPARFGHEGAIGYAAFPMEGGTYETATISMFVRTRKPSGLLFALKKGSSLFLKVWLEDGKLVLSSPSSSRLQGTLPVNDGNFYFITLKIEPNKAELIQSSQNLGYISTPWVKIEKGDIIYVGGLAESQETSINGGYFKGCIQDLRLNNQPLEFFPVTPLMNSVISKNTLINIDPGCTGDNLCKSNPCKNSGVCYSIWDDFTCTCPPNTAGKACEEVKWCELSPCPHEAQCQLVHQGFECIANAIFSGRNSAIFYRSNGKIKRDLTKIAFGFRTQDSDVILLYAEKEPEFISISIQKTKLVFQLQSGNSFYGLNLATSKPVNDGKWHQVTFSMAEPSSQSSTWRMDLDGEKDSATSMVTTGNLNFLREGTDIYLADRPFDDLNGLSGCMSTIEISGIHLSYFDSADGYTKRPQEEQFLKISANSVATGCSQLNACSANPCMNNGRCEDFYTHYHCKCAKGWTGTYCDINIDECASNPCVHGNCSDRTASYTCICDLGYSGTRCEEDIDDCHGHLCANGATCVDGINGYSCLCAGNFTGRFCRRIRPPSTVCGNGNRNITCYNYGNCSELQGYLECVCLPGFVGQRCEVDVNECNSDPCLHGGICQNLVNKFHCVCEVNYAGERCEIDLTTDVASNVFTSIGSVTLALLLIFLLVGTVSIITANKRATQGTYSPSRQEKEGSRVEMWDMVQPPPMERLI

SEQ ID NO: 40 - protein, 1285 aa, Homo sapiens
  MISC_FEATURE: Homo sapiens CRB2 isoform 1
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 41 - protein, 1116 aa, Homo sapiens
  MISC_FEATURE: Homo sapiens CRB2 isoform 2
YTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRWDGWAGGWAANAPWGYGGAEKSARSVDESLPFPGPHVLICDMRRTV

SEQ ID NO: 42 - protein, 953 aa, Homo sapiens
  MISC_FEATURE: Homo sapiens CRB2 isoform 3
MAMEPGALWTFLGHLWLLAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 43 - protein, 1285 aa, Pan troglodytes
  MISC_FEATURE: Pan troglodytes CRB2 isoform 1
MALARPGTPDPQALASVLLLLLWAPALSLLAGTVPSEPPSACASDPCAPGTECQATESGGYTCGPMEPRGCATQPCHHGALCVPQGPDPNGFRCYCVPGFQGPRCELDIDECASRPCHHGATCRNLADRYECHCPLGYAGVTCETEVDECASAPCLHGGSCLDGVGSFRCVCAPGYGGTRCQLDLDECQSQPCAHGGTCHDLVNGFRCDCAGTGYEGAHCEREVLECASAPCAHNASCLEGLGSFRCLCWPGYSGELCEVDEDECASSPCQHGGRCLQRSDPALYGGVQATFPGAFSFRHAAGFLCHCSPGFEGADCGVEVDECASRPCLNGGHCQDLPNGFQCHCPDGYAGPTCEEDVEECLSDPCLHGGTCSDTVAGYICRCPETWGGRDCSVQLTGCQGHTCPLAATCIPTFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCQPLPCVHGGSCVDLWTHFRCDCARPHRGPTCADEIPAATFGLGGAPSSASFLLQELPGPNLTVSFLLRTREPAGLLLQFANDSAAGLTVFLSEGRIRAEAPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTVGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAAATSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPPKECGLNVTCLDGSLCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 44 - protein, 1267 aa, Macaca mulatta
  MISC_FEATURE: Macaca mulatta CRB2 isoform 1
LLLLWAPALSLLAGTVPSEPPSACASDPCAPGTECQATKSGGYTCGPTEPRGCATQPCHHGALCVPQGLDPDGFRCYCVPGFQGPRCELDIDECASRPCHHGATCRNLADRYECHCPLGYAGVTCETEVDECASAPCVHGGLCLDGVGSFRCVCAPGYGGTRCQLDLDECQSQPCAHGGTCHDLVNGFWCDCTGTGYEGTRCEQEVLECASAPCAHNASCLEGLGSFRCLCWPGYSGELCEVDEDECASSPCQHGGRCLQRSDPALYGGVQATLPGTFSFRHAAGFVCHCPPGFEGADCGVEVDECASRPCLNGGRCQDLPNGFQCHCPDGYTGPTCEEDVDECLSDPCLHGGNCSDTVAGYICRCPETWGGRDCSVQLTGCQGHTCPLAATCIPIFESGVHSYVCHCPPGTHGPFCGQNTTFSVMAGRPIQASVPAGGPLGLALRFRTTLPAGTLATRNDTRESLELALVAATLQATLWSHGTTVLVLRLPDLGLNDGHWHQVEVVLHLATLELRLWHEGCPARLCVASGPVALAPTASATPLPAGISSAQLGDATFAGCLQDVRVDGHLLLPEDLGENVLLGCERREQCQPLPCVHGGSCVDLWTHFRCNCPRPHRGPTCADEIPAATFGLGGAPSSVSFLLQELPGPNLTLSFLLRTRESAGLLLQFANDSAAGLTVFLSEGRIRAEAPGGPAVVLPGRWDDGLRHLVTLSFGPEQLQDLGQHMHVGGRLLAADSQPWGGPFRGCLQDLRLDGRHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPVAFSGHNASSGRSLGSLSLAFRTRDSEAWLLRATAGALAGVWLAVRNGSLAGGVRGGHGLSGALLPIPGPRVADGAWHRVRLAMERPAAAPSRWLLWLDGAATPVALRGLAGDLGFLQGPGAAHILLAENFTGCLGRVALGGLPLPLARPRPGVAPGAQEHFAAWPGTPAPILGCRGAPVCAPSPCLHGGDCRDLFDAFACACGPGWEGPRCEAHVNPCDSAPCARGRCHTHPDGRFECHCPPGFGGPRCRLPVPSKECILNVTCLDGSPCEGGSPAANCSCLEGLAGQRCQVPALPCETNPCLNGGTCRAAGGVSECICNARFSGQFCEVVKGVPLPLPFPLLEVAVPAACACLLLLLLGLLSGILAARKRRQSEGTYSPSQQEVAGARLEMDSVLKVPPEERLI

SEQ ID NO: 45 - protein, 953 aa, Macaca mulatta
  MISC_FEATURE: Macaca mulatta CRB2 isoform 2
MAMEPGALWTFLGHLWLLTGPTCEEDVDECLSDPCLHGGNCSDTVAGYICRCPETWGGRDCSVQLTGCQGHTCPLAATCIPIFESGVHSYVCHCPPGTHGPFCGQNTTFSVMAGRPIQASVPAGGPLGLALRFRTTLPAGTLATRNDTRESLELALVAATLQATLWSHGTTVLVLRLPDLGLNDGHWHQVEVVLHLATLELRLWHEGCPARLCVASGPVALAPTASATPLPAGISSAQLGDATFAGCLQDVRVDGHLLLPEDLGENVLLGCERREQCQPLPCVHGGSCVDLWTHFRCNCPRPHRGPTCADEIPAATFGLGGAPSSVSFLLQELPGPNLTLSFLLRTRESAGLLLQFANDSAAGLTVFLSEGRIRAEAPGGPAVVLPGRWDDGLRHLVTLSFGPEQLQDLGQHMHVGGRLLAADSQPWGGPFRGCLQDLRLDGRHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFHEGPPVAFSGHNASSGRSLGSLSLAFRTRDSEAWLLRATAGALAGVWLAVRNGSLAGGVRGGHGLSGALLPIPGPRVADGAWHRVRLAMERPAAAPSRWLLWLDGAATPVALRGLAGDLGFLQGPGAAHILLAENFTGCLGRVALGGLPLPLARPRPGVAPGAQEHFAAWPGTPAPILGCRGAPVCAPSPCLHGGDCRDLFDAFACACGPGWEGPRCEAHVNPCDSAPCARGRCHTHPDGRFECHCPPGFGGPRCRLPVPSKECILNVTCLDGSPCEGGSPAVNCSCLEGLAGQRCQVPALPCETNPCLNGGTCRAAGGVSECICNARFSGQFCEVVKGVPLPLPFPLLEVAVPAACACLLLLLLGLLSGILAARKRRQSEGTYSPSQQEVAGARLEMDSVLKVPPEERLI

SEQ ID NO: 46 - protein, 1283 aa, Sus scrofa
  MISC_FEATURE: Sus scrofa CRB2 isoform 1
MALARPGTQDLMPPVPLLLLLLLLWAPALALPTGTVPSETPGACASDPCAPGTECQATESGGYTCGPTEPRGCASQPCHHGALCVPQDPDPNGFRCYCVPGFQGPHCELDIDECASRPCHHGATCRNLADRYECHCPLGYAGVTCESEVDECASAPCLHGGSCLDGVGSYRCVCAPGYGGASCQLDLDECQSQPCAHGGVCHDLVNGFQCDCADTGFEGTRCEQEVLECASSPCAHNASCLEGLGSFRCLCWPGYSGEWCEVDEDECASGPCQHGGQCLQRSDPTLYGGIQAAFPGAFSFRYAAGFLCRCPLGFEGDDCSVDVDECASRPCLSGGLCQDLPNSFQCHCPDGYTGPTCQEDVNECLSEPCLHGGTCEDTVAGYICWCPETWGGHDCSVQLTGCEGHTCPLAATCIPTFKSGVHSYTCRCPPGTHGPLCGQNTTFSVVAGNPVRAVVPAGGPLGLALRFRTTVTSGPLATRSDTQDSLELALVGAMLQATLRSRGNNVLVLRLLDMALNDGYWHQVEVALRLGVLELRLWHEGCPARLCMASSPVALPPLASQAPMPAGFCSSQLGGGAFAGCLQDVHVDGHLLLPEDLGENVLLGCGRQEQCQPPPCAHGGACVDLWTHFLCDCPRPYSGPTCADEVPAATFGLGGTLSSASFLLNQLPGPNLTVSFLLRTREPAGLLLQFANDSAAGLTVFLSEGQIRAEVLGSPALLLPGRWDDGLRHLVMLSFGPDHLQSLGQQVHVGGRLFPADAQPWGGPFRGCIQDLRLNGLHLPFFPPLLGNSSQPSAPGSRQSWNLTMGCVSEDTCSPDPCLNGGTCLVTWNDFHCTCPANFTGPTCAQQLWCPGQPCLPPATCEEVPDGFVCVAEATFREGPPAEFSGHNASSGRALSGLSLAFRTRDPEAGLLRAEDAPATIWLAVRNGSLAAGVRSGPSLPGAVLPAPGPRVADGAWHRVRLAMERPEAAASRWLLWLDGAATPVALRGLAGDLDFLRGPGAARVLLAENFTGCLGRVALGGLPLPLARPRPGAAPGSREPFSAWPGAPAPLLGCRGAPVCVPSPCLHGGACRDLFDAVACACGPGWEGPRCEARADPCRSAPCARGRCHARPDGRFECRCPPGFAGPRCRLPVLPEECSPNITCLSGAPCEGGPQGANCSCQESFAGQRCQIPCEANPCLNGGTCRAAGGVYECICSTRFSGQFCEVVKGLPLPLPFPLLEVAVPAACACLLLLLLGLLSGIMAARKRRQSEGTYSPSQQEVAGARLEMDSVLKVPPEERLI

SEQ ID NO: 47 - protein, 1288 aa, Spermophilus tridecemlineatus
  MISC_FEATURE: Spermophilus tridecemlineatus CRB2 isoform 1
MALAGPGTRDCRPLAPLLLLLLLLLPPWDPALALLAGTVPSEIRGDCASDPCAPGTQCQATESGGYTCGPVKPQGCATQPCHHGALCVPQGPDPNGFRCYCVPGFQGPHCELDIDECASRPCHHGATCHNLADRYECQCPLGYAGVTCEAEVDECASAPCLHGGSCLDGVGSYRCVCAPGYAGASCQLDIDECQSQPCAHGGVCHDLVSGFRCDCSGTGYEGARCEEEVLECTSDPCANNASCLEGLGSFRCLCWPGFTGELCEVDEDECAAGPCLNGGLCLQRSDPALYGGAQAAFPGAFSFRHAAGFLCRCPPGFEGDDCSVDVDECSSWPCLNGGHCQDLPNGFQCHCGDGYAGLTCQEDVDECLSGPCLHGGTCDDAVAGYICQCPEPWGGHDCSVQLTGCLGHTCPPAATCIPTFKSGVHSYVCHCPPGTHGPFCDQNTTFSVVAGSPVWASVPAGGPLGLALRFCTTLPAGALATRTDTQGSLELALVGATLQVTLSHGTHALVLSLPDLTLNDGHWHQVEVALRLGNLELRLWHEGCPSHLCVASGPVVPSPTASVAPRSPGPCSTQLGSSAFAGCLQDVYVDGHLLLPEHLSDNVFLGCERQEQCQPLPCAHGGTCVDLWTHFHCDCPRPHSGPTCADEIPAATFGLGGTPSAASFLLPELPGPNLTVSFLLRTREPAGLLLQFANASAAGLTVFLREGQVWAEALGSPAVPLPGRWDDGLRHLVTLSFGPDQLQDVGQQVHVGGRPLPADIQPWGGPFRGCLQDLRLNGLHLPFFPLRPENSSQLSELGGQAQNLTRGCVSEDMCSPDPCFNGGTCLVTWNDFHCTCPGNFTGPTCAQQLWCPSQPCLPPATCEEVPDGFVCVAEATFQEGPPAAFSGHNMSSGHRLSGLALAFRTRDTEAGLLRASAGAQAGLWLAVRNGSLAASVRSGRGMSGAVLPAPGPRVADGAWHRVRLAMEQPAAAASRWLLWLDSAATPVALRGQAGHLDFLQGLDAARVLLAENFTGCLGRVAIGGLPLPLAGPRPGVSPGPREHFAVWPGSPAPRLGCLGAPVCASSPCLHGGACRDLFDAFACACGPGWEGPRCEAPADPCRSAPCARGRCHARPNGHFECRCPPGFAGPRCRTPLLLEKCSFNLTCLDGDTCEGGPPGTNCSCQKGFAGQRCQNPTPPCEANPCLNGGTCRKVDGAYECVCSTRFSGQFCEVVKGLPLPLPFPLLEVAVPAACACLLLLLLGLLSGILAARKRRQSEGTYSPSQQEVAGARLEMDSVLKVPPEERLI

SEQ ID NO: 48 - protein, 1275 aa, Otolemur garnetti
  MISC_FEATURE: Otolemur garnettii CRB2 isoform 1
MALARPGTWAPRAPVPVLLLLLGTPALALLAGTEPPESLSSCASDPCAPGTQCQNTDSGGYTCGPVEPQGCDSQPCYHGALCVPQGSGPSGFRCYCVPGFQGPHCELDINECASRPCHHGATCHNLADRYECLCPLGYAGVTCEAEVDECASAPCLHGGTCQDRVGSYSCKCAPGYEGDRCQLDLDECQSQPCAHGGTCHDLVNGFRCDCADTGYEGERCEQEVLECASAPCAHNATCLEGLGSFSCLCWPGYSGDRCEVDIDECAAGPCQHGGQCLQRSNPALYGGVHATFPGAFSFHHAAGFLCHCPPGFEGDDCSVDVDECASQPCLNGGHCQDLPSSFQCHCREGYAGLTCQEDVDECLSDPCLHGGTCNDAVAGYICRCPEAWGGPNCSVQLTGCQGHTCPLAATCIPVFESGVHSYICLCPPGTHGPLCGQNTTFSVVAGSPVQASVPAGSPLGLALRFRTTLPTGALATRASTQDSLELALVEAILQATLWSHDTTVLVLRLPDLALNDGQWHQVEVVLHPGTLELRLWHEACPAQLCVASGPVTLAPTALVAPVGHFSAQLGGAAFAGCLQDVHVDGHLLLPENLSENVLVGCEHREQCQPLPCAHGGACVDLWTHFRCDCPRPHRGPTCADEIPAATFGLGGTLSSASFLLQEPPAPNLTVSFFLRTREPAGLLLQFANDSAAGLTVFLSDGQIRAEALGSPTVVLPGRWDDGLRRLVMLTFGPDQLQDLGPQVHVGGRLLPADSQPWGGPFRGCLQDLQLNGHHLPFFPLRPLENSSQPSELGGRQFQNLTMGCISEDTCTPDPCFNGGTCLVTWNDFHCTCPANFTGPTCAQQLWCPGQPCLPPATCEEVPDGFVCVAETTFREGPPAAFSVLSGHWLSGISLAFRTRDREAWLLRATAGTQAGVWLAVRNGSLVAGVRGHGLPGAVLPAPGPRIADGAWHRVRLAMERPTAASSRWLLWLDSAATPMALRGLAGDLGFLHGPGAARILLAENFTGCLGRVALGGLPLPLGRPRPGATLGPREHFVAWPGSSVVRLGCSSAPVCEPSPCLHGGTCRDLFDAFACACGPGWEGHRCEARADPCRSAPCARGRCHVRPDGRFECRCLPGFVGPRCRLPAPPEECSLNLTCPCQGGPRGASIAFSNPSLTRCRIPSPPCEANPCLNGGTCRAAAGVSECICSARFSGQFCEVAKGTPMPLPFPLLEVVVPAACACLLLLLLGLLSGILAARKRRQSEGTYSPSQQEVAGARLEMDSVLKVPPEERLI

SEQ ID NO: 49 - protein, 1281 aa, Bos taurus
  MISC_FEATURE: Bos taurus CRB2 isoform 1
MALAWPGTRDPRPSAHLLLLLLLLHRAPVLALPAGTVPSETPGACASDPCAPGTKCQATENAGYSCVPLEPRGCASQPCHHGALCVPQGPGPDDFRCYCVPGFQGPHCELDIDECASRPCHHGATCRNLADRYECHCPLGYEGVTCETEVDECASAPCLHGGSCLDGVGSYRCVCAPGYGGASCQLDLDECQSQPCAHGGVCRDLVNGFRCDCADTGYEGERCELEVLECASAPCANNASCLEGLGSFRCLCWPGYSGERCEVDEDECAVGPCQHGGQCLQRSDPTLYGGIQATFPDDFSFRQAAGFVCRCPPGFEGDDCGEDVDECASRPCLSGGLCQDLPNGFHCHCPDGYTGPTCQEDMDECLSEPCLHGGTCEDTVAGYICGCPEAWGGLDCSVPLTGCQGHTCPPTATCVPTFESGVHSYTCRCPPGTHGPFCGQNTTFSMVAGNPLRASVPAGSSLGLALRFRTTIRVGALATCSDTQGSVELALVEARLQATLWSHGKNVLVLRLLEPPLNDGHWHRVEVTLRLGVLELRLWHEDCPAHLCVASSPMATAAPAPTPAGSRFTQLGGVAFAGCLQDVQVDGHLLLPEDLGENVLLGCWHQEHCQPPPCAHGGVCVDLWTHFHCDCPRPYRGPTCADEVPAATFGLGGTLSSASFLLDQPPGPNLTVSFLLRTREPAGLLLQLTNGSAAGLTVFLSEGQIWAEALGSPALVLPGRWDDGLRHLVTLSFGPDQLWGVGQQVHVGGRLLPGDAEPWGGPFRGCMQDVRLNDLHLPFFPPLLGNSSLPSVPGRGQSWNLTMGCISEDTCNPEPCLNGGTCLVTWNDFHCTCPANFTGPTCAQQLWCPGQPCLPPATCEEVPDGFVCVAEATFREGPPAEFSGHNASSGSALSGLSLVFRTRDPEAGLLRAEDGPAAVWLAVRNGSLAAGVRSGAGLPRAVLPAPGPRVADGAWHRVRLAMEQPAAVASRWLLWLDGAATPVSLRGLAGDLDFLRGPGAARVLLAENFTGCLGRVALGGHPLPLARPRPGAAPGSREPFSARPGAPAPHLGCSGAPVCVPSPCLHGGACRDLFDAFACACGPGWEGPRCEDRADPCRSAPCARGRCHAHPDGHFECRCPPGFAGPRCRLPVPPEGCSLNITCLNGGQCEEGPQGANCSCQESFAGQRCQIPCEANPCLNGGTCRAADGVYECVCNARFSGQFCEVVKGLPLPLPFPLLEVAVPAACACLLLLLLGLLSGILAARKRRQSEGTYSPSQQEVAGARLEMDSVLKVPPEERLI

SEQ ID NO: 50 - protein, 1206 aa, Bos taurus
  MISC_FEATURE: Bos taurus CRB2 isoform 2
CASQPCHHGALCVPQGPGPDDFRCYCVPGFQGPHCELDIDECASRPCHHGATCRNLADRYECHCPLGYEGVTCETEVDECASAPCLHGGSCLDGVGSYRCVCAPGYGGASCQLDLDECQSQPCAHGGVCRDLVNGFRCDCADTGYEGERCELEVLECASAPCANNASCLEGLGSFRCLCWPGYSGERCEVDEDECAVGPCQHGGQCLQRSDPTLYGGIQATFPDDFSFRQAAGFVCRCPPGFEGPTCQEDMDECLSEPCLHGGTCEDTVAGYICGCPEAWGGLDCSVPLTGCQGHTCPPTATCVPTFESGVHSYTCRCPPGTHGPFCGQNTTFSMVAGNPLRASVPAGSSLGLALRFRTTIRVGALATCSDTQGSVELALVEARLQATLWSHGKNVLVLRLLEPPLNDGHWHRVEVTLRLGVLELRLWHEDCPAHLCVASSPMATAAPAPTPAGSRFTQLGGVAFAGCLQDVQVDGHLLLPEDLGENVLLGCWHQEHCQPPPCAHGGVCVDLWTHFHCDCPRPYRGPTCADEVPAATFGLGGTLSSASFLLDQPPGPNLTVSFLLRTREPAGLLLQLTNGSAAGLTVFLSEGQIWAEALGSPALVLPGRWDDGLRHLVTLSFGPDQLWGVGQQVHVGGRLLPGDAEPWGGPFRGCMQDVRLNDLHLPFFPPLLGNSSLPSVPGRGQSWNLTMGCISEDTCNPEPCLNGGTCLVTWNDFHCTCPANFTGPTCAQQLWCPGQPCLPPATCEEVPDGFVCVAEATFREGPPAEFSGHNASSGSALSGLSLVFRTRDPEAGLLRAEDGPAAVWLAVRNGSLAAGVRSGAGLPRAVLPAPGPRVADGAWHRVRLAMEQPAAVASRWLLWLDGAATPVSLRGLAGDLDFLRGPGAARVLLAENFTGCLGRVALGGHPLPLARPRPGAAPGSREPFSARPGAPAPHLGCSGAPVCVPSPCLHGGACRDLFDAFACACGPGWEGPRCEDRADPCRSAPCARGRCHAHPDGHFECRCPPGFAGPRCRTDYTGSPTGEALVPSASPVPSLSHFAVICNLGTTAPRVCRRLPVPPEGCSLNITCLNGGQCEEGPQGANCSCQESFAGQRCQIPCEANPCLNGGTCRAADGVYECVCNARFSGQFCEVVVSDGRRLEVAVPAACACLLLLLLGLLSGILAARKRRQSEGTYSPSQQEVAGARLEMDSVLKVPPEERLI

SEQ ID NO: 51 - protein, 1287 aa, Loxodonta africana
  MISC_FEATURE: Loxodonta africana CRB2 isoform 1
VSAPEFCPERQTTPVLLLSVMCLPTLTSQCPLSTGELPSEIPSACASDPCAPGMECRTTENGGYTCGPTEPQGCATQPCHHGALCVPQGPDPNGFRCYCVPGFQGPHCELDINECASRPCHHGATCRNLADHYECHCPLGYTGVTCETEVDECASVPCLHGGSCLDGVGSYRCVCAPGYGGASCQLDLDECQSQPCAHGGICHDLVNGFQCDCADTGYEGVRCEEEVLECASAPCAHNASCLEGLGSFRCLCWARGYSGERCEVDEDECAAGPCQHGGQCLQRSEPGLYGGAQAVFSGAFSFRHAAGFLCRCPPGFEGDDCSVDVDECASQPCISGGRCQDLPNGFKCHCPDGYTGLTCQEDVDECLSEPCLHGGTCHDTVAGYTCWCPEPWDGHDCSVQLTGCQGHTCPLATTCIPIFESGVHSYICRCPPGTDGPFCGQNTTFSVAAGSPVWASVPAGSPLGLALRFRTTLPAGALATRTDTQDSLELALLGATLQATLRSHGVTVLILRLPDLALNDGHWHQVEVALRFGTLELRLWHEGCPARLCVASGPVALAPMSSVAPSPAGLCSTQLGGAAFGGCLQDVRVGYLLLPEELGNVLLGCERHEQCQPLPCAHGGACMDLWTDFHCDCPRPYSGPKCTDEVPAATFGLGGTLSSAFFLLHEPPGPNITISFLLRTREPAGLLLQFANDSAAGLTVFLSGGQIRAEALGSPVLELPGPWDDGLRHLVTLSFGPNQLQGLGQQVHVGGGLLPAESQPWGGPFRGCLQDLQLNGLHLPFFSLSLGNLSEPSKLDSRQTQNLTLGCVSEDMCSSNPCLNGGTCLVTWNDFHCTCRANFTGPTCAQQLWCPGQPCLPPATCEEVPDGFICVAETTFLEGPPAEFSGHNVSAVHTFGGLSLAFRTRDLEAQLLSAAAGAHASVWLAVRNGSLAAGVRSGLELPGAVLSAPGPRVADGAWHRVSLAMEHPAAAASRWLLQLDDALTPVALRGLAGDLDFLRGPGAARILLAENFTGCLGRVALGGLPLPLAHPRPGAAPDSGERFAAWPGKPAPRLGCRGAPVCAPTPCLHGGTCRDLFDAFACACGAGWEGPRCEVPADPCRSAPCARGRCQARPDGHFECRCPPGFVGPRCRLPVLLEECGLNFTCLNGGRCEAGPWGANCSCQEGFAGRRCQIPIFPCEANPCLNGGTCRAAGGEYECTCSATFSGQFCEVVKGLPLPQPFPLLEVAVPAACACLLLLLLGLLSGILAARKRRQSEGTYSPSQQEVAGARLEMDSVLKVPPEERLI

SEQ ID NO: 52 - protein, 1212 aa, Loxodonta africana
  MISC_FEATURE: Loxodonta africana CRB2 isoform 2
TEPQGCATQPCHHGALCVPQGPDPNGFRCYCVPGFQGPHCELDINECASRPCHHGATCRNLADHYECHCPLGYTGVTCETEVDECASVPCLHGGSCLDGVGSYRCVCAPGYGGASCQLDLDECQSQPCAHGGICHDLVNGFQCDCADTGYEGVRCEEEVLECASAPCAHNASCLEGLGSFRCLCWASPGYSGERCEVDEDECAAGPCQHGGQCLQRSEPGLYGGAQAVFSGAFSFRHAAGFLCRCPPGFEGLTCQEDVDECLSEPCLHGGTCHDTVAGYTCWCPEPWDGHDCSVQLTGCQGHTCPLATTCIPIFESGVHSYICRCPPGTDGPFCGQNTTFSVAAGSPVWASVPAGSPLGLALRFRTTLPAGALATRTDTQDSLELALLGATLQATLRSHGVTVLILRLPDLALNDGHWHQVEVALRFGTLELRLWHEGCPARLCVASGPVALAPMSSVAPSPAGLCSTQLGGAAFGGCLQDVRVGACGNVLLGCERHEQCQPLPCAHGGACMDLWTDFHCDCPRPYSGPKCTDEVPAATFGLGGTLSSAFFLLHEPPGPNITISFLLRTREPAGLLLQFANDSAAGLTVFLSGGQIRAEALGSPVLELPGPWDDGLRHLVTLSFGPNQLQGLGQQVHVGGGLLPAESQPWGGPFRGCLQDLQLNGLHLPFFSLSLGNLSEPSKLDSRQTQNLTLGCVSEDMCSSNPCLNGGTCLVTWNDFHCTCRANFTGPTCAQQLWCPGQPCLPPATCEEVPDGFICVAETTFLEGPPAEFSGHNVSAVHTFGGLSLAFRTRDLEAQLLSAAAGAHASVWLAVRNGSLAAGVRSGLELPGAVLSAPGPRVADGAWHRVSLAMEHPAAAASRWLLQLDDALTPVALRGLAGDLDFLRGPGAARILLAENFTGCLGRVALGGLPLPLAHPRPGAAPDSGERFAAWPGKPAPRLGCRGAPVCAPTPCLHGGTCRDLFDAFACACGAGWEGPRCEVPADPCRSAPCARGRCQARPDGHFECRCPPGFVGPRCRYRGWEWGAERGNLGAAVPPRGREGSRARLGTRLGDLRSHQRLPVLLEECGLNFTCLNGGRCEAGPWGANCSCQEGFAGRRCQIPIFPCEANPCLNGGTCRAAGGEYECTCSATFSGQFCEVVVSDVRGVGVAVPAACACLLLLLLGLLSGILAARKRRQSEGTYSPSQQEVAGARLEMDSVLKVPPEERLI

SEQ ID NO: 53 - protein, 1253 aa, Callithrix jacchus
  MISC_FEATURE: Callithrix jacchus CRB2 isoform 1
  misc_feature (1019)..(1019): Xaa can be any naturally occurring amino acid
MALARPGPLVPQLPAPRPPGPVLLLLLLWVPALALLAGTVPSEPPSACASDPCTPGTECQATESGGYTCGPTEPRGCATQPCHHGALCVPQGPDPDDFRCYCVPGFQGPRCELDIDECASRPCHHGATCHNLADRYECHCPLGYAGVTCETEVDECASTPCLHGGSCLDGVGSFRCVCVPGYGGSRCQLDLDECQSQPCTHGGTCHDLVNAFRCDCAGTGYEGAHCEQEVLECASAPCAHNASCLEGLGSFRCLCWPGYSGERCEVDEDECAASPCQHGGQCLQRSDPALYGGVQPAFPDVFSFRHAAGFLCLCPPGFEGADCSVEVDECASQPCLNGGHCQDLTNGFQCHCPDGYAGPTCQEDVDECLSDPCLHGGTCSDTVAGYICWCPEPWGGRDCSVQLTGCQNHTCPLAATCIPIFESGVHSYVCNCPPGTHGPFCSQNTTFSVMAGSLIQASVPAGGPLGLALRFRTTLPTGTLATRNDTKESLELALVKATLQATLWSHGTTVLVLRLPDLALNDGHWHQVEVALRPGTLELRLWHESCPARLCVASGPVALAPTASATLLPARISFARLGDMAFAGCLQDVHVDGHLLLPEDLGENVLLGCKRQEQCQPLPCVHGGACVDLWTHFHCDCPRPYRGLTCADEIPAATFGLGGTPSSASFLLQELPGPNLTVSFLLRTREPAGLLLQFANDSTAGLTVFLSEGRIRAEVPGSPAVVLPGRWDDGIRHLVTLSFGPDHLQDLGQQVHVGGRLLAADSQPWGGPFRGCLQDLQLDGHRLPFLPLPLDNLSQPSELGGRQSWNLTAGCISEDTCNPDPCFNGGTCLVTWNDFHCTCPANFTGPTCAQQLWCPGQPCLPPATCEEVPDGFVCECVAWAAPVLGAGHPSWLDAICMLRACQILVDQACQAPGQCGRAPEVSLRCEVGQFHGGGKGPDSAGSCCCWACDLEGRLSIALSPALAWNCPSGGRSEGGGGAAPVSRIQDEMIGGCVGPHPHDGPHPSLPGESGEVAFNGEDXPILGCRGAPVCAPRPLHGGACRDLLDAFACCGPGWEGPRCEAHVDPCHSAPCARGHCHTHSDGGFECRCPPGFGGPHCRLPVPSQDCSLNVTCLNSSRCKGGSPAANCSCLEGLADQRCQVPTLPCEANPCLNGGTCRAAGGASECICSARFSGQFCEVVKGLPLPLPFPLLEVAVPAACACLLLLLLGLLSGILAARKRRQSEGTYSPSQQEVAGARLEMDSVLKVPPEERLI

SEQ ID NO: 54 - protein, 1184 aa, Callithrix jacchus
  MISC_FEATURE: Callithrix jacchus CRB2 isoform 2
LLLLLLWVPALALLAGTVPSEPPSACASDPCTPGTECQATESGGYTCGPTEPRGCATQPCHHGALCVPQGPDPDDFRCYCVPGFQGPRCELDIDECASRPCHHGATCHNLADRYECHCPLGYAGVTCETEVDECASTPCLHGGSCLDGVGSFRCVCVPGYGGSRCQLDLDECQSQPCTHGGTCHDLVNAFRCDCAGTGYEGAHCEQEVLECASAPCAHNASCLEGLGSFRCLCWPGYSGERCEVDEDECAASPCQHGGQCLQRSDPALYGGVQPAFPDVFSFRHAAGFLCLCPPGFEGADCSVEVDECASQPCLNGGHCQDLTNGFQCHCPDGYAGPTCQEDVDECLSDPCLHGGTCSDTVAGYICWCPEPWGGRDCSVQLTGCQNHTCPLAATCIPIFESGVHSYVCNCPPGTHGPFCSQNTTFSVMAGSLIQASVPAGGPLGLALRFRTTLPTGTLATRNDTKESLELALVKATLQATLWSHGTTVLVLRLPDLALNDGHWHQVEVALRPGTLELRLWHESCPARLCVASGPVALAPTASATLLPARISFARLGDMAFAGCLQDVHVDGHLLLPEDLGENVLLGCKRQEQCQPLPCVHGGACVDLWTHFHCDCPRPYRGLTCADEIPAATFGLGGTPSSASFLLQELPGPNLTVSFLLRTREPAGLLLQFANDSTAGLTVFLSEGRIRAEVPGSPAVVLPGRWDDGIRHLVTLSFGPDHLQDLGQQVHVGGRLLAADSQPWGGPFRGCLQDLQLDGHRLPFLPLPLDNLSQPSELGGRQSWNLTAGCISEDTCNPDPCFNGGTCLVTWNDFHCTCPANFTGPTCAQQLWCPGQPCLPPATCEEVPDGFVCECVAWAAPVLGAGHPSWLHLHAQGLSDISGPGMPSPRAVWQGPRMRRDRVSAGGEPVLGFKAQPREWKDISLRGHSMAKSLRSARTAEVQRGEQERGGKVERLCRRPVRQLTLSPRVAGSLRGRLRLHCGPGWEGPRCEAHVDPCHSAPCARGHCHTHSDGGFECRCPPGFGGPHCRLPVPSQDCSLNVTCLNSSRCKGGSPAANCSCLEGLADQRCQVPTLPCEANPCLNGGTCRAAGGASECICSARFSGQFCEVVKGLPLPLPFPLLEVAVPAACACLLLLLLGLLSGILAARKRRQSEGTYSPSQQEVAGARLEMDSVLKVPPEERLI

SEQ ID NO: 55 - protein, 1276 aa, Cavia porcellus
  MISC_FEATURE: Cavia porcellus CRB2 isoform 1
MALTRPVTQDSRPLCAVLLAWSPALTLVAGTVPSETLSGQTSEPCASGSCAPGTKCQTTESDGHTCGPMEPQGCATQPCQHGALCVPQGPDPNSFQCYCVPGFQGPHCELDIDECASRPCHHGATCHNLADRFECRCPLGYAGVTCEAEVDECASAPCLHGGSCLDGVGSYLCMCAPGYGGASCQLDLDECHSQPCAHGGTCHDQVNGFRCDCAGTGYEGARCELEVLECASAPCAHNATCLEGLGSFRCLCWPGFSGEWCEVDEDECASSPCQNGGLCLQRSDPALYGGAQAPLPGAFSLRHAAGFLCRCSAGFEGDNCSGDVDECASGPCLNGGRCQDLPNGFQCHCLDGYTGLTCEEDVDECLSEPCLHGGTCDDTVAGYTCWCPETWGGHDCSVQLTGCQGHTCPLAATCIPIFKSGIHSYACRCPPGTHGPDCGQNTTFSVVAGIPVWASVPGGGPLGLALRFRTTLPAGALATRTDTQNSLELELVEGTLQVTLWSHGATTLVLRLPGMVLNDGHWHPVEVALRLGTLELRLWHEGCPSGLCVASGPVAPGSTALVTLGPSEPCSARLGGSAFAGCFQDVLVDGHLLLLGNLSGNVVLGCEHREQCQPLPCAHGGACVDLWTHFHCDCPRPYSGPTCANEIPAATFGLRGALSSISFLLLELPGLSLTVSFFLRTREPAGLLLQFANDSVAGLTIFLDGGQIRATVPGSSTVELPGRWDDGLRHLVTLSFGPDQLQGLGQQVHVGGRLLPADSQPWGGPFRGCLQDLRLNGLRLPFFPLPGDNSSQLSELGQSQNLTQGCISEDTCSPNPCLNGGTCLVTWNDFHCTCPDNFTGPTCAQQQWCPSQPCLSPATCEEVPDGFVCVAEATFREGPPAAFTAHNVSGRSLSGLSLAFRTRDPEGGLLRVPAGADAGLWLAVSNGSLVARVRSGGDAAGAVLHAPGPRVADGAWHRVRLAMERPAAAASRWLLWLDGAATPAALRGLAGDLSFILLAENFTGCLGRVALGGLPLALARPRPGAPTGSREHFVPWPGAPAPSLGCRGAPLCPPSTYLPGVTCRDLFRSPVPAGPGWEGPRCEARVDPCRSAPCARGWCHARPDGRFECRCPLGFTGARCRLPILPEGCTLNLTCLNGGPCKAGPGGANCSCQEGSAGQRCQSLPLPCEANPCLNGGTCQASGGVYECTCSSGFSGPICEVVKGLPLPLPFPLLEVAVPAACACLLLLLLGLLSGILAARKRRQSEGTYSPSQQEVAGARLEMDSVLKVPPEERLI

SEQ ID NO: 56 - protein, 1198 aa, Gorilla gorilla
  MISC_FEATURE: Gorilla gorilla CRB2 isoform 1
GTVPSEPPSACASDPCAPGTECQATESGGYTCGPMEPRGCATQPCHHGALCVPQGPDPNGFRCYCVPGFQGPRCELDIDECASRPCHHGATCRNLADRYECHCPLGYAGVTCETEVDECASAPCLHGGSCLDGVGSFRCVCAPGYGGTRCQLDLDECQSQPCAHGGTCHDLVNGFRCDCAGTGYEGTHCELEVLECASAPCAHNASCLEGLGSFRCLCWPGYSGELCEVDEDECASSPCQHGGRCLQRSDPALYGGVQAAFPGTFSFGHAAGFLCHCPPGFEGADCGVEVDECASRPCLNGGHCQDLPNGFQCHCPDGYAGGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYGTTVLVLRLSDLALNDGHWHQVEVVLHLATLELRLWHEGCPARLCVASGPVALASTASATPLPAGISSAQLGDATFAGCLQDVRVDGHLLLPEDLGENVLLGCERREQCQPLPCVHGGSCVDLWTHFRCDCARPHRGPTCADEIPAATFGLGGAPSSASFLLQELPGPNLTVSFLLRTREPAGLLLQFANDSAAGLTVFLSEGRIRAEAPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCECVSWAAPVLGAGHLSWLDPICTLRACRILVDQACQAPGQCGGATACRRTEFLEKVSLYWASGPDSESHRGKDILWSGIACAKSLWSARTVEVQGGKQEWGGKVELLLPVACDLEGRLGIAPHPPARAGNCSSMGRKYIGSRSGCVCPTPMGRGVGCECPLGLWWGREVCQVCARTQAQVAHGHSAGEGRSQVSCTHSSLCSLPRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 57 - protein, 1011 aa, Gorilla gorilla
  MISC_FEATURE: Gorilla gorilla CRB2 isoform 2
TVPSEPPSACASDPCAPGTECQATESGGYTCGPMEPRGCATQPCHHGALCVPQGPDPNGFRCYCVPGFQGPRCELDIDECASRPCHHGATCRNLADRYECHCPLGYAGVTCETEVDECASAPCLHGGSCLDGVGSFRCVCAPGYGGTRCQLDLDECQSQPCAHGGTCHDLVNGFRCDCAGTGYEGTHCELEVLECASAPCAHNASCLEGLGSFRCLCWPGYSGELCEVDEDECASSPCQHGGRCLQRSDPALYGGVQAAFPGTFSFGHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYGTTVLVLRLSDLALNDGHWHQVEVVLHLATLELRLWHEGCPARLCVASGPVALASTASATPLPAGISSAQLGDATFAGCLQDVRVDGHLLLPEDLGENVLLGCERREQCQPLPCVHGGSCVDLWTHFRCDCARPHRGPTCADEIPAATFGLGGAPSSASFLLQELPGPNLTVSFLLRTREPAGLLLQFANDSAAGLTVFLSEGRIRAEAPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 58 - protein, 1282 aa, Mus musculus
  MISC_FEATURE: Mus musculus CRB2 isoform 1
MALVGPRIWGPRRDIYPLLLLLLLLLLLLLPWVPAGLVPPETPSVCASDPCAPGTKCQATESGGYTCEPSELGGCATQPCHHGALCVPQGPDPNSFRCYCVPGFQGPHCELDIDECASRPCQHGGTCQNLADHYECHCPLGYAGVTCEAEVDECSSAPCLHGGSCLDGVGSYRCVCAPGYAGANCQLDVDECQSQPCAHGGVCHDLVNGFRCDCADTGYEGARCEQEVLECASAPCAHNASCLDGFRSFRCLCWPGFSGERCEVDEDECASGPCQNGGQCLQRSDPTLYGGVQAIFPGAFSFSHAAGFLCSCPLGFAGNDCSMDVDECASGPCLNGGSCQDLPNGFQCYCQDGYTGLTCQEDMDECQSEPCLHGGTCSDTVAGYICQCPEAWGGHDCSVQLTGCQGHTCPLAATCIPTFKSGLHGYFCRCPPGTYGPFCGQNTTFSVVSGSSVWGLVPAAASLGLALRFRTTLLAGTLATLKDTRDSLELVLVGAVLQATLSRHGTAVLILTLPDLALNDGHWHQVEVTLHLGTLELRLWHEGCPGQLCVASGPVATGPTASVASGPPGSYSIYLGGGVFAGCFQDVRVEGHLLLPEELKGTVLLGCERREPCQPLPCAHGGACVDLWTHFRCDCPRPYRGATCTDEVPAATFGLGGATSSASFLLHQLGPNLTVSFFLRTREPAGLLLQFANDSVASLTVFLSEGQIRAEGLGHPAVVLPGRWDDGLPHLVMLSFGPDQLQDLGQRLYVGGRFYPDDTQLWGGPFRGCLQDLQLNSIHLPFFSSPMENSSWPSELEAGQSSNLTQGCVSEDTCNPNPCFNGGTCHVTWNDFYCTCSENFTGPTCAQQRWCPRQPCLPPATCEEVPDGFVCVAEATFREGPPAVFTGHNVSSSLSGLTLAFRTRDSEAGLLRAVSAAGAHSNIWLAVRNGSLAGDVAGSVLPAPGPRVADGAWHRVRLAREFPQAAASRWLLWLDGAATPVALHGLGGDLGFLQGPGAVPLLLAENFTGCLGRVALGDFPLPLAPPRSGTVSGAREHFVAWPGSPAVSLGCRGGPVCSPSPCLHGGACRDLFDAFACSCGPAWEGPRCEIRADPCRSTPCVRGQCHARPDGRFECRCPPGFSGPRCRLPVLPQGCNLNSTCKDGAPCEGGPLGTNCSCQEGLAGLRCQSLDKPCEASPCLNGGTCRVASGIFECTCSAGFSGQFCEVVKTLPLPLPFPLLEVAVPAACACLLLLLLGLLSGILAARKRRQSEGTYSPSQQEVAGARLEMDSVLKVPPEERLI

SEQ ID NO: 59 - protein, 1283 aa, Rattus norvegicus
  MISC_FEATURE: Rattus norvegicus CRB2 isoform 1
MALLGPVIWGFRRDVYLLLLLLLLLLPPWVPAGLVPSETPNVCASDPCAPGTRCQATESGGFTCEPLELGGCAAQPCHHGALCVPQGPDPNGFRCYCVPGFQGPHCELDIDECASRPCHHGGTCRNLADHYECHCPLGYAGVTCEAEVDECSSAPCLHGGSCLDGVGSYRCVCAPGYAGASCQLDVDECQSQPCEHGGVCHDLVNGFRCDCADTGYEGARCEQEVLECASAPCVHNASCLDGFRSFRCLCWPGFSGERCEVDEDECASDPCHNGGRCSQRSDPTLYGGVQAIFPGAFSFSQAAGFLCSCPPGFAGDDCSVDVNECASEPCLNGGSCQDLPNGFQCYCQDGYTGLTCQEDTDECQSEPCLHGGTCSDTVAGYICQCPEAWGGHDCSVQLTGCQGHACPLAATCIPTFKSGFHSYICRCLPGTYGSFCDQNTTFSVVSGSSVWGLVPAGASLAFALRFRTTLLAGALATLKDSRDSLELVLVGAMLQATLWRRGTADLVLTLPDLALNDGHWHQVEVTLRLGTLELRLWHEGCPGQLCVVSGTVATDPTASVASGSPEPYSIHLGGRAFAGCFQDVRVEGHLLLPEELKGSVLLGCERTEPCQPLPCANGGACVDLWTDFRCDCPRPYHGSKCTDEVPAATFGLGGVMSSATFLLHQMLGPNLTVSFFLRTREPASLLLQFANDSVASLTVSLSEGQIRAEVLGHPAVILPGRRDDGLRHLVVLSFGPDQLQDLGQWLYVGGRLYPDDTQPWGGPFRGCLQDLQLNGIHLPFFSSPMENSSWPSELEAGQSSNLTQGCVSEDTCNPNPCFNGGTCHITWNDFYCTCPDNFTGPTCAQQRWCPRQPCLPPATCEEVPDGFVCVAEATFREGPPAVFTGHNVSSSRALSRVTLAFRTRDLEAGLLRAASAAGAHSNIWLAVRNGLLAVDVAGSVLPAPGPRVADGAWHRVRLAREFPQAAASRWLLWLDGAATPVALHGLGGDLGFLQGPGAVPLLLAENFTGCLGRVALGDLPLPLAPPRSGAMSGAREHFMAWPGSPPAVSLGCRGGPVCTPSPCLHGGACLDLFDVFACSCGPAWEGPRCEIHADPCRSSPCVRGQCNTRPDGRFECRCPPGFSGPRCRLPTLPQGCSLNSTCKDGAPCGGGPLGTNCSCQEGLAGLRCQSLDQPCEASPCLNGGTCRVTSGIFECTCSAGFSGQFCEVVKTLPLPLPFPLLEVAVPAACACLLLLLLGLLSGILAARKRRQSEGTYSPSQQEVAGARLEMDSVLKVPPEERLI

SEQ ID NO: 60 - protein, 1189 aa, Ailuropoda melanoleuca
  MISC_FEATURE: Ailuropoda melanoleuca CRB2 isoform 1
GTVPSEPPSVCDSAPCAPGTQCQAMENGSYSCAPTEPRGCATQPCHHGALCVPQGPDPDGFRCYCVPGFQGPRCELDIDECASRPCHHGATCHNLADRYECRCPLGYEGVTCEAEVDECASAPCLHGGSCLDGVGSYRCVCAPGYGGASCQLDLDECHSQPCAHGGRCRDLVNGFRCDCADTGYEGVRCEQEVLECASAPCANNASCVEGLGSFRCLCWPGYSGQRCEVDEDECESGPCQHGGQCLQRSDPALYGGVQATFPGAFSFRHAAGFLCRCAPGFEGDECGVDVDECASQPCLNGGRCQDLPNGFQCHCLDGYTGVACQEDVDECLSEPCLHGGTCDDTVAGYICQCPEAWGGHDCSVRLTGCQGHTCPPAATCIPIFKAGVHSYACRCPPGSRGPFCGQNTTFSVVAGSPVQTSVPAGGTRGLALRFRTTLPAGALAARTDTQDSLELALAGGTLQATLWDHGNTTVLTLKLPDLALNDGRWHEVEVSLRLAVLELRLWHEDCPAGLCVASRPVAPAPVASEAPTPAGFCSIQLGGRAFEGCLQDVHVDGHLVLPEDLGKNVLLGCERREQCQPPPCAHGGACVDMWTHFHCRCTRPYSGPTCADEVPAATFGLGGTLSSASFLLYQLPGPNLTVSFLLRTREPAGLLLQLANDSVAGLTVFLSEGQVQAEVLGHPTLVLPGRWDDGLRHLVTLSFGPNQLQGLGQRVHVGGRLLPADAQPWGGPFRGCLQDLRLNDLHLPFFPLLLGNSSQPGELGSRESWNLTLGCVSEDTCSPDPCLNGGICLVTWNDFHCTCPVNFTGPTCAQQLWCPGQPCLPPATCEEVPDGFVCVAEATFREGPAAAFSGHNASSGVSLSGLSLAFPRDSEAGLLRASAGGQEAVWLEVHNGGLGEPRARFGKTAWSLSAWPPTIDGPSSPLVLRGWQGQSEVARGFDASPLLSGFDSPLLLEQAYRRDFPLPQGLEVTHLVGGGAEATGRQPCAPSLPPQVGPECHSSGRGGSGGLWWPAVALGAGPGPQRAAPSAASVLLPRWPILPEECGLNLTCLSGPCEGGPPGANCSCQEGFAGQRCQLPCEANPCLNGGTCRAAGGLYECICSARFSGQFCEVVKGLPLPLPFPLLEVAVPAACACLLLLLLGLLSGILAARKRRQSEGTYSPSQQEVAGARLEMDSVLKVPPEERLI

SEQ ID NO: 61 - protein, 1213 aa, Myotis lucifugus
  MISC_FEATURE: Myotis lucifugus CRB2 isoform 1
  misc_feature (865)..(865): Xaa can be any naturally occurring amino acid
CATQPCYHGALCVPQGPGPNDFRCYCVPGFQGPRCELDIDECASRPCHHGATCRNLADRYECHCPLDYAGVNCEVEVDQCASAPCLHGGSCLDGVGSYRCVCAPGYGGASCQLDLDECQSQPCAHGGVCHDLVNGFRCDCGDTGYEGARCEQEVLECASAPCAHNATYLEGLGGFRCLCWPGYSGELCEVDEDECAAGPCQHGGQCLQRSDPALYGGAQAAFPGAFSFRRAAGFLCRCPPGFEGDDCSVDVDECASGPCLGGGSCQDLPNGFRCHCPSGYTGLTCQEEVDECLSEPCLHGGTCDDITAGYTCRCPEDWGGQDCSVQLTGCQGHTCPLAATCIPTFESGVHSYVCRCPPGTHGPACGQNTTFSMVAGNPVRASVPAGGPLGLALRFRTTLPAGALATRTDSQDSLELELALAAATLQATLWSHGSPVLVLRLPDLALNDDHWHRVEVTLRLEVLELRLWHEGCPAQLCVASSSVPPAPTASPATPPAGFRSVQLGGADFAGCLQDVHVDGHLLLPEDLGEHVLLGCRRREQCQPLSCAHGGACVDLWTHFHCDCPRPYSGPTCADEVPAATFGLGGALSSASFLVPRLPGPNLTVSFLLRTREPAGLLLQLADDSAAVLTVFLSEGQIRAEVRGGPALVLPGPWDDGLRRLVTLSFGSEQLQGSGLQVHVGGRRLPADAQPWGGPFRGCLQDLRLNGLHLPFFPLPLGNASQPRKLGSRQAWNLTAGCVSEDLCRPSPCLNGGTCLVTWNDFHCTCPANFTGPTCAQQLWCPGQPCLPPATCEEVPDGFVCGVAEATFLEGPPVPFSGHNASSGHEFSGLSLAFRTRDSEAGLLRPPRGHPGRRLAGRPQRLAGGXPGTGEEEPGMVREAGSRRAESRAADAPGLWGRPPPLSEPPALVVNGNHSPLDLPGRGHAIHVGNPELVWEETLDGASPKAQRAPLMFTALVPWEGGRVRWAPIHPWLHAPVLWSQGYGGLSVGGLTSWVPPLPPGMSGPRCAKECTFVLSRVLPLCQLLKGLDPGKIPGLGWVGLDSPAATSDTTCLTDTRDYRSLFLPRLPVLPEGCRLNVTCPCEGGPQGANCSCQEGFAGQRCQLSCEANPCLNGGTCRVAGGVYDCACSARFSGQFCEVVKDLPLPLPFPLLEVAVPAACACLLLLLLGLLSGILAARKRRQSEGTYSPSQQEVAGARLEMDSVLKVPPEERLI

SEQ ID NO: 62 - protein, 1152 aa, Oryctolagus cuniculus
  MISC_FEATURE: Oryctolagus cuniculus CRB2 isoform 1
SACASRPMRPQGTECQATDSGGLHLVGPAEGGCASQPCHHGPLLLCCPNGPKIPHGFRCYCVPGFQGPCELDIDECASQPCHHGATCRNLADRFQCHCPLGYAGVTCEAEVDECASAPCLHGGSCLDGVGSYRCACTPGYGGARCQLDLDECQSQPCAHGGTCHDLVNGFRCDCAGTGYEGARCEQEVLECASAPCANNASCLEGLGNFRCLCWPGWATLRMPYPGGPQLCRPGVSCKVGLRAAPAPGALGGAKWPEARGTDTRRSSAGHSGHATQDCTRELSRVESGGGGPGAQVHRRRRKGFGFGIQGREKCVTCEEDVDECLSEPCLHGGRCEDAVAGYSCWCPEAWGGPDCAVRLTGCRGHTCPPAATCVPSFESGVHSFVCRCPPGTHGPACDQNTTFSVVAGSPVRAAVPAGGPPGLALRFRTTLPAGVLATRTDTQDSLELALQGATLRATLWRHGTSALVLRLPDLALNDGRWHPVEVAPRPGSLELRLWHEGCPARLCVASGPVALPPTASVAPVPEGPCSVQLGGAVFAGCLQDVHVDGRLLPPEALAGNVLVGCARREQCQPLPCAHGGACVDLWTHFRCDCPRPHSGPTCADEVPAATFGLAGTPSSASFLLPEPPGPNLTVSFLLRTREPAGLLLQFANDSATSLTVFLSEGRIRAEVPGGPPVVLPGRWDDGQRRLATLSFGPDQLQGLGRQVHVGGRLLPADAQAWGGRFRGCLQDLRLNDLRLPFFPPRLENSSRPGELDGRQARNLTVGCVSEDVCSPNPCFNGGTCLVTWNDFQCTCPDNFTGPTCAQQLWCPGQPCLPPATCEEVPDGFVCEFDPEPPWWVLDSGGLGGRALYPERVIFGGHRISGVGNSIGKGPEVFRGCLGRVALGGLPLPLARPRPGVGPGAREHFAAWPGTPGPSPGCRSAPVCEPSPCLHGGACRDLFDAFACACGPGWEGPRCEARADPCHSAPCARGRCHARPDGRFECRCPPGFAGPRCSVPVLAEGCSLNITCLDGGPCEAGPQATNCSCPEDLAGPRCRVPVLPCDANPCLNGGTCQAAGGASECICSAGFSGRFCEVAKGLPLPLPFPLLEVVVPAACACLLLLLLGLLSGILAARKRRQSEGTYSPSQQEVAGARLEMDSVLKVPPEERLI

SEQ ID NO: 63 - protein, 1406 aa, Monodelphis domestica; identical to SEQ ID NO: 33
  MISC_FEATURE: Monodelphis domestica CRB2 isoform 1

SEQ ID NO: 64 - protein, 1121 aa, Sarcophilus harrisii
  MISC_FEATURE: Sarcophilus harrisii CRB1 isoform 1
YRCDCAGSGFTGKHCETLLPVCWSQPCHHNGTCEELDDTYICHCWPGFTGSHCEIDINECSSNPCLSTGECVERSWANQYGRISELPSEFNYLHATGYVCHCQPGYTGIRCEDDIDECSSDPCKNGGTCENFPGNYTCHCPAQDYQGIIYGGVDCREIFLGCIRNKCQNDGICIPYIQNGQHESSCLCPPGYSGSLCDIVTTFSFEGNSFLWMTSGSGITPFHIALSFQTVQSSALLLLRGDKDTYVKLELWNGYVYLSVQVNNQSKVLLHISHNTSDGEWHSVEVTLAEAVTLTLRDNSCVEKCVDKAPSPIDSDQVMIAFQNTFLGGLPVGKTNDGAALLNIYNLHSAPSFVGCLQDIEIDSNLITPENISSGSSFNVKAGCNKKDWCENHPCQNRGRCINLWLSYQCDCYRPYEGVNCLREYTAGRFGQDDSTGYALFRLDNNQEQIVTLSMFVRTRKSYSFLLALKNSTFQYINVWLEHGRLAVLTPSSSRLLGRSLLNDGNIHLITLKMEPKKIELYQSSQNLGYLSTPTWKIRSGDVLYVGGLPDKKETEVWGGYFKGCIQDIRLNSHKLELFPISKGNSTLNQTLVNVTPGCPGDNLCKYNPCHNGGVCYSIWDDFTCSCPPNTAGKACEEVKWCELSPCPPESQCQLVSKGFDCSIANAVFHGQESTIFFRSNGKITRELTNITFGFRTRNSNIILLYAEKEPEFITISIQNSRLVFQLQSGNSFYMLSLRSMQPVSDGMWHQVFLSMIEPFAQSSRWRMEVDDQTTIVTSLVATGNLNFLREETNIYLGDKPFDNLDGLQGCLSSVEISGIYLSYFENAVVHTKKPQEEQFLRISTNPVIVGCSQVDACSSNPCLHNGECEDFYNSYGCVCRKGWTGTHCEINVDECFSRPCIYGNCSDRIAGYICRCNSGYTGVNCETNIDDCENHQCANGATCIDGISNYSCQCLSNYTGKFCRQTRLPMTVCGNERRNLTCYNHSNCTELQGDLKCVCRPGFTGQWCEKDINECDSDPCLNGGLCRNLLNTFQCNCDGNFAGERCELDLTDNLISDIFTAIGSITLAVLLILFLAVVASFIASNKRANQGTYSPSRQEKEGSRVEMWNMVQPPPMERLI

SEQ ID NO: 65 - protein, 1324 aa, Sarcophilus harrisii
  MISC_FEATURE: Sarcophilus harrisii CRB2 isoform 1
CEELYDACSERVCPHNQTCHAAPGALNHTCRCPPGSWGPTCDTAGCGDHGCPGSCAVQPCHHGGTCLAAGAGSACLCLPGWTGPLCEEDVDECKSGPCQNGALCVNDPGGFLCYCVPGFQGPHCELDINECASRPCKHEASCINRVDGYQCLCSPGYTGLNCETEIDECESDPCQNGGSCLDGIGTYQCLCSPGFTGHNCQVDIDECESQPCANGGICQNFINRFQCDCGGTGFEGALCEVEVLECLSSPFLHIATCLEGLGNYTCVCLPGYHGEHCEMDEDDCAGDPCLHGGLCLQRSNQSLYGGAQPVFPGTFSYSSAAGFVCQCLPGFAGDNCSVDVNECESHPCQNGGTCEDLPNSFQCHCLAGLLSRPFFSGEDCGQFSLCSLLPSSSPHSVSLSALSACLSLSPHSLSSLCNSQVTGSLVLSSMLSSSDVFWSPFLKVMIAFVFISLPLLNICYHFSLSQRAFSLNKELNVSELLPLGGATGILHISCRVMIEAGLGSNRAGVSPQSPSLFLSVSLFLTLSLSFSSFSPSLSLFLSFPPLPASISFSLTASFISGGGGCGLQGVLWPTARSLMKKSPAPGLMYNSCTLQVTGRHVEEEGREGSQTFSCLSGLMGASWRGDGRSWISLPCRWERREGPLCHSWVGQEAGEDGGAQLGHLLRAWDSSQGSTLDLRISNRGRHLSTLLIRLNSSEHGFLRLWVSRGELRVEVAAAAQVVALPGRLDDGHKHLVTLGLGRGQLQGPPLGPSYEVYVGGLASAAWAQPWGGNFKGCLQDIRLNSLRLDLLPLLQPDNRTGSGGALEGRASNLTLGCVSEDTCRFDPCHNGGTCTVTWNDFICSCPHNFTGPTCAKRLWCQAQPCPPSTTCAEVPDGYVCLANATFQDQPPAVFTSHNMSAQRELVALSLAFRTRDLEAVLLQAAGEGASLRVAIHNGSLSVSVRSGNSVEGATFGGVAPVSDGAWHLVSLAMEEPAASLSRWQLRLDEAQNVTLWGQAGTLDFLRHHVRVVLAENFTGCLGRVTVGGLDLPFARLPTPLPQPEQFLLEGGGVDLGCRGHPVCSAEPCLHGGTCQDLFDAFSCACGASWNGPRCEVDVDECGSAPCVHGRCRNLPGSYQCQCSAGYTGKHCESDVDDCLEHSCLHGATCVDGLLSYSCRCPPEFFGPRCQWPFPPEECGRNFTCLNGGHCSDGPWGANCSCPMGFTGLRCQIRIPECEPNPCQNGGTCQAAGSEVECICSSNFGGRHCDVADLVTLFSFPLIEVVVPVACGCLLLLLIGLLSGVLAARKRRQSEGTYSPSQQEVAGARLEMDSVLKVPPEERLI

SEQ ID NO: 66 - protein, 1241 aa, Sarcophilus harrisii
  MISC_FEATURE: Sarcophilus harrisii CRB2 isoform 2
PGSCAVQPCHHGGTCLAAGAGSACLCLPGWTGPLCEEDVDECKSGPCQNGALCVNDPGGFLCYCVPGFQGPHCELDINECASRPCKHEASCINRVDGYQCLCSPGYTGLNCETEIDECESDPCQNGGSCLDGIGTYQCLCSPGFTGHNCQVDIDECESQPCANGGICQNFINRFQCDCGGTGFEGALCEVEVLECLSSPFLHIATCLEGLGNYTCVCLPGYHGEHCEMDEDDCAGDPCLHGGLCLQRSNQSLYGGAQPVFPGTFSYSSAAGFVCQCLPGFAGDNCSVDVNECESHPCQNGGTCEDLPNSFQCHCLAGYTGEDCGQFSSLCLSLPFPPFSEFSLCMCCPSEMLECVSLNEAERRELSLSLCGIPAMCMLAHILGYTHLGVHTPSPSTGMPFSPLRHPPPSPVQIPPSASLSLAQAWAQLFHPVITQAGSLDRGKAFSSSWNFQAPETFQFSRSMSFLMLNVSELLPLGGATGHRVICEVIGLQMLKLYLLLSSCPGLQLLDLAGPTAQCPTQTDPDLPGPHVCKGDEMTSLLPGAVLGGLLLLAVRGGRLVFMVFIRKTRCLPMIPQTRSCLSWAELCCCRDRRLGRTEGPSSVTYSGLGTALKARLWTLGLVMGRHLSTLLIRLNSSEHEQLINSFSNSSPGNITRAISAGELRVEVAAAAQVVALPGRLDDGHKHLVTLGLGRGQLQGPPLGPSYEVYVGGLASAAWAQPWGGNFKGCLQDIRLNSLRLDLLPLLQPDNRTGSGGALEGRASNLTLGCVSEDTCRFDPCHNGGTCTVTWNDFICSCPHNFTGPTCAKRLWCQAQPCPPSTTCAEVPDGYVCLANATFQDQPPAVFTSHNMSAQRELVALSLAFRTRDLEAVLLQAAGEGASLRVAIHNGSLSVSVRSGNSVEGATFGGVAPVSDGAWHLVSLAMEEPAASLSRWQLRLDEAQNVTLWGQAGTLDFLRHHVRVVLAENFTGCLGRVTVGGLDLPFARLPTPLPQPEQFLLEGGGVDLGCRGHPVCSAEPCLHGGTCQDLFDAFSCACGASWNGPRCEVDVDECGSAPCVHGRCRNLPGSYYSCRCPPEFFGPRCQWPFPPEECGRNFTCLNGGHCSDGPWGANCSCPMGFTGLRCQIRIPECEPNPCQNGGTCQAAGSEVECICSSNFGGRHCDVAKGPPVTLFSFPLIEVVVPVACGCLLLLLIGLLSGVLAARKRRQSEGTYSPSQQEVAGARLEMDSVLKVPPEERLI

SEQ ID NO: 67 - protein, 1275 aa, Otolemur garnetti; identical to SEQ ID NO: 48
  MISC_FEATURE: Otolemur garnettii CRB2 isoform 1

SEQ ID NO: 68 - protein, 1466 aa, Danio rerio
  MISC_FEATURE: Danio rerio CRB2a
MEIRKVHLKGPGTVLLTMMMFKWGIFCSGSSDLCASSPCQNGATCVDTMDDYVCLCSREGVRYMGRDCEELYNACMFAECEGCESELGTDHYTCPEDKDECKSGPCVGPHSECVNEQNGYKCLCPPGFGGEDCSHRITDCIDEPCLNNGTCRRIVDGFECACSDGFRGETCEEDLDECDSHPCQNGAICLDGVNKYQCFCVPGYQGHNCEIDINECASRPCWNNGTCINGKDRYLCDCLLGYTGVNCELEIDECESNPCQNGATCHDLVGLYTCDCVQGFEGSDCEINIDECESGPCQNGGLCHDRIDSYECECEGTGYMGDHCEEDIPECASHPCQHGGTCLEGINHYNCSCWPGFEGGNCEVDIDECADAPCENDGECFEKSNPEHWETDWEFTYATAVGYVCQCQPGYTGENCSVNINECVSEPCHNGGSCKDLVNGYMCECPEGFTGVECEVNIDECESAPCLNGGVCEDGVAEYKCHCAEAEEGLLPWGGPQCTVQLLGCIGHECQNGATCLPWLDGETHGHTCLCPPGFYDDVCSIQTTFSFSSPRFFLIELPSLERRRRETEPEHPLGVRLRFRTTLPDMLLFFRGNAEFFLSLEIVGGELRARATSKEEGSLEAQLPGLVSDGDWHEAIVNINEHDIRLVLQVKGANCNNQACRVEDKLQDGHETFLHHDSLTKVYVGGVPEEYIGLTLSGQGFLGCMEDLQVDGHPVLPHDLGHEEESVELGCVKTEWCQEDPQPCSQQGHCVDLWTSYRCDCYRPHYGQDCSKDMPTWTFGHENSTSFLAFELLSDFGSNFSVSFFLRSLKSSGLLFQLRRSGVQGTEDEPYFTIYLEMGRLQVTSMAESPILSSPVFVSNGEKPLLQVDIQDGQVFFNHGGYRYGLGLLPDLEVLEGDLLYIGGVPGEEGATVWGGHFKGCLQDLRLDDVHLDVEDWNNTLSESIYIASDSENVLPGCTSDDTCKMEPCLNGGACTVTWNDFICSCPKDFTGKTCETRVWCVSDPCINGGHCVDLLDGFECIANATFDNTPLHYSAKGSLLDPVTNVTMKLRTRQENGVLLRAWRGEELLLIGLLDSSIHVEIHTANSVEPVKFSGQRRIADGNWHRLLFAMAHPEHDASQWFVLVDGIIDGSSAPVLAGSLNFLKDISSEVALAETFTGCLGAVRVGGVYLPFVDNTKSPQTTRFWRRPDEHVHLGCFGAPVCRSHPCRRGGTCVDLFNKFGCKCPSGWEGNICEKEIDECISGPCLHGKCKDKLNGFDCLCHPGYAGPTCSENIDDCKGSRCKNGGTCVDGVNDFTCICPPKYSGTRCQYNYPPLKCALDVECENDGVCHDTPWGANCTCPPGFTGERCEREIDECASSPCLNGGSCLDRLNRFQCLCPAGFSGQFCETNKQAQQDHIPWLAIAVPLACGCILLVAIGLIFMLMTARKKRQSEGTYSPSHQEVAGARLEMDSMLKVPPEERLI

SEQ ID NO: 69 - protein, 1010 aa, Danio rerio
  MISC_FEATURE: Danio rerio CRB2b
MRGLIVKVICCGLPLLTGAVCETELDECESDPCQNGGRCEDSINAYTCHCPPAEPGHLPWGGPDCSVQLTGCVDQPCQNNATCIPSIQHQQHQHTCRCPSGFHGTHCQTSTTFSITRGGYLLIDLHHKNNRSRRYLDSHVPSVQLRFRTTLQDGVIFFRGGQNHFFVLELIAGELCCRAQSGDLKLFVKLSGDFGDGFWRGVSVGVDEGLTVLSEGEMGEDGSHNQLLSFQPQGLETLYVGGVPQEWMNLTLSRTGFVGCLEDLVVDSEPVLPQSLVPLQEVQMGCERTEWCRVNPCSDHGRCVDLWSNYTCVCHRPYYGEHCSEEHTSWTFSHERNRSFAAFPIMQNHSRDVTVSLWLRSRHLNGLVLQLQHDNQPYLTLFLKNGSLYISIYSSIRRASDFLTNGEKLFMSIKTEPGVILFNQTQRIPMIYSGFEVQVGDVVYLGGLPEGENSALWGGYFKGCLQDVRIDDTQLFMYSGSISQKPQHANYLPRNSSNVLEGCVGDQTCKMKPCLNGGKCQVIWNDFMCLCPLNFSGKTCETRVWCVSDPCDPRTRCVDLPDGYECLANATFENNALKFSANGSFFEPVMRISMDLRTREENGTILRSSNGIEFFCMGLLNSSIIVKFRDSNSLEVHAFISDVTVSDGEWHKVELYASSSRISAFRWHMSIDGNPAGFSLSPAGNVDFFNSSTVMLAENYTGCLGEVRIGGVHLSFFGPLNEEAPQKTQFIRIGGMLEPHLGCIGSPLCLSEPCLNNGTCTDLFNLAVCKCAPGWTGERCQENIDECGEQPCVQGSCQDLLGDYECRCPVGFGGKNCDVEVDQCKDHQCENGGSCVATVSGYTCVCLPGHTGPYCRWRFPPRECDVDLQCENGGVCSEGSWGANCTCRPGFTGVRCELDIDECVSEPCLNGGSCVNRHNLYFCECLPDFSGENCQITKQLQQELWPWLLLLVPLAGLSVLLAALALLCLIFSARKKRRSEGTYSPSRQEAAGARMEMGSVLKVPPEERLI

SEQ ID NO: 70 - protein, 1473 aa, Latimeria chalumnae
  MISC_FEATURE: Latimeria chalumnae CRB
LDFFLSTIAYLTEAGLILKYFLTGALCSEYVHKCSSAPCQNNGTCVELDHDYNCMCPDQPVVYIGKNCEHLYNKCSIHPCPNNSSCSSTPGLANYNCSCTLGATGLDCYVQLHKCESNPCSGLNYECKEYTNGYSCQCRAGYTGEDCKTSTLKCSTNLCQNNGTCVETGAENYTCLCEPGYLGVNCEVDINECDSSPCKNGAICVNKANGYNCFCVPGFQGYNCEIDINECASRPCQNNGTCFNEMDGYLCKCILGYTGINCEVEINECESDPCQNGGTCRDHVGFYTCTCAPGYKGDQCQIDIDECASQPCNNRGTCHDSSNRYICNCSGTGFMGENCEIDILECASDPCVNNATCQEGVNNYTCLCWNGYTGRHCEIDINECDEGPCLNGGICYERSNQSYYGSLSEFNYKFSYRSAAGYICCCQPGFTGEDCSINIDECESQPCQNGGTCEDLIDKFNCFCTPGFTDVTCGSNINECEQNPCKNGGTCKDGIADYSCLCLPMDENGIVWGGKNCSIQLSGCQEDNCHNGGLCIPSFENEIHGYTCKCPPGFYDDTCSTPTTFSFTSPGYVIVEMPTNNRSKRDEGEPTVSIGLRFKTTLPNMVIAYRGDETEYLFLELFNGHMHAALKSDNTTPTLFIEDQLVNDGKWYEAMVVLNDSLQLILWGTNCSDNVCIAQHSIEDHAQLLINSFKTIYIGGLNDSLLSNTRSRESFVGCMEDFKLDSRIVLPQTVSESMSFQMTLGCNKTEWCNSDPCSGKGHCVDLWTSSRCDCFRPHTGPNCSYEYIPATFGKEGARSFALFNITDNSEAKFSVSFFIRTLKPKGVILQINNTTASYFTVYLSEGKIHVKSLSPHVVTLDKNLADGLKHFISINVSTELVTLSFNQSETVQSGRLTSIKLGAGDAAYVGGTPYENDLNKWGGYFKGCLQDMRITEHQLEFFLQETDISVRHNVYKAEEINNITQGCVSDNTCNPHPCRNGGTCKVLWNDFVCSCPMNFTGRTCKEKVWCASNPCPIQSQCQNIPGGYECLANATFQDNNMVAYITNGSITKDLTVISLDIRTRDTDANLLQATNGAKSLWIGLQNSELQVRIRSGNILEDLDILSKMILEDGLWHRVNVSMEEPSAVSSRWIVCVDGVSNMTTQGTAGNLNFLNENTVVVLAENFTGCLGQVRIGGIHLPFIEGQTFPQQEQFFKHSGGPLHLECVGADVCSQNPCFNNGQCEDQFNSFSCNCSAGWEGSLCESNINDCKSTPCFNGNCSDLIADYTCDCFPGFNGRNCELNVDDCLEHQCQNGGTCIDGENSYSCNCDAQYTGYYCEWLYPPVQCGKDFSCLNGGQCTNGAWGANCTCKPGFTGEKCETNINDCSPSPCQNGGTCQDFVNKYECICGANFTGEHCEIDKEEEMLQIPLIAVAVPVVCGCLLLLIIGLIFMVLTARKKRQSEGTYSPSQQEVAGARLEMDSVLKVPPEERLI

SEQ ID NO: 71 - protein, 1457 aa, Takifugu rubripes
  MISC_FEATURE: Takifugu rubripes CRB2 isoform 1
MEMPEITLNLKTLLLTMMMFKWGILCTATSERCLSGPCQNGASCVDTVDDYACICPTGGVRYMGKNCDELYDACFFAPCENCTSTPDGLSGDNCTEEIDECHSSPCSYPRSLCVDQLNGYFCRCPEGFGGRDCRAHVTDCIDGPCMNNGTCVLQPEGFECDCAPGFEGETCEEDINECLSDPCQNGAICTNGVAEFHCFCVPGFQGYNCELDINECASRPCENNATCINEKDHYECECLMGFAGVNCEIEINECESNPCWNGATCHDLVGIYACECVPGFDGPTCSLDVDECASEPCQNGAVCHDMVNSYNCDCSQTGFEGDLCDIDIPECDSNPCQHGGRCIDQVNGYICLCWPGYEGANCETDINECTEEPCENGECFERSDPSYWESDWELTFADLAGYICHCHPGFAGENCSVNIDECESEPCQNGATCEDQINAYTCLCSAGFQGELCEENIDECESQPCENGGWCEDGRASYSCHCPEAEAGQVPWGGLHCHVKLYGCVDHQCMNGAFCQPWLEEGQHGHTCLCPHGFYDDHCSTRTTFSFSTPGFMLLHAVPAESDHGELEHHVHPGFGVQLQFRTTIPNMLVFFRGDADSHLLLEIVNGGLQAKAFSEESEMNVRFTGLVSDGDWRGVHVFLDEDALVLVLKGSGCDRDGCKVTDVGVDGPFHPSESFSQVYIGGAPTELLMHSLSGTGFIGCMEDVMVDSKPFLPQTLPEDQRPELGCSKVDWCEADPCYGHGHCVDLWSSYQCDCFRPFYGKNCSHEFPSWTFSHEDTLSFSLFEVKKTFGSSFNVSFFLRSLKLDGLLFQLRRPTDREGQVYFSVYLGMGRIFVSSLPNGASLSAPVFVTTGEQKLLRIEVQKNQVIFEHAGLRYRIGRIPEVSLNNGDQAFIGGLPGNLDSDMWGGHYKGCLQDFRLNSVHLDMEAWDISGEEELNLASDTALIRVGCISDDTCKMEPCLNGGECSVTFNDFTCSCPEEFTGKTCETRVWCVSDPCVNGGRCVDLPDGYECLNNATFENDPLLYSSGGSVTHPVTDIYVELRTRSENAVILRAFWGSHLLLMGLLDMSVHVEIRSGNSVETVTFTGHRGVSDGKWHRVNISMSERERSSSPWLITVDGITDANSAPQHTGAVHFLKEKSAMVTVAESFTGCLGALRIGGIYLPYSKDPGAPQHSHFHLDGAADVRLGCSGAPVCDPDPCLNGGVCEDQFNRFSCICELGWEGGHCETDVDDCASQPCVHGSCRDFLAGFECLCQPGFTGPLCTEDIDDCENHACEHGGTCEDGPNAYICLCPENYRGPLCQWVYPPEQCGRDVQCANEGVCADGLWGANCTCVPGFTGSRCETEVNECQSNPCHNGGSCLDRFNMFVCECPPDYTGSTCDVNKQGRRQGVSWLMVVVPLLLLCALVMAICLTFMVLTARKKRQSEGAYSPSAQELAGARLEMDSMLKVPPEERLI

SEQ ID NO: 72 - protein, 1259 aa, Gallus gallus
  MISC_FEATURE: Gallus gallus CRB2 isoform 1
TGPSYSENDSSCSSSPCENGGSCKDLEAGYQCICHNIDECASNPCQNGAICRDRVNEYSCFCVPGFQGYNCEIDINECASRPCKNNGTCLNEMDHYLCKCIPGYTGVNCEAEIDECDSYPCQNGALCSDHIGFYTCTCMPGYQGIQCEVDINECISQPCQHNGTCHDLINSYQCDCSDTGFEGDHCELDILECASEPCLNNATCVEGIKNYSCACWTGYTGQHCEEDVNECATDPCHNGGVCFERSNQSYYGSQPDFPSDFSYSQAAGFLCWCQPGFAGETCFTNINECESQPCQNGGHCVDLVDGFLCHCLPGYSGVECAVNINECEEGPCKNGAVCEDGIADYTCHCAPSQDGIVWGGKNCSVKLTGCQTHDCQNEALCIPTYQAESHGHLCQCQPGFYDATCSTPTTFSFASRGYLLIELPVNNQSSVSLRFRTTLPSAILFYRGHEAEYLFLELLDGILRTELKRQDEYLLLLEELRVDDGHWHKVEVVLQNTVQLKLWHDSCDAGVCMQSSPIPHNATPIPHAFLSVYIGGAQDPLANNTQSQQGFVGCLEDLQVDAEAVLPVALPVSEVSSVTQGCDRTEWCLSEPCFHGGLCVDLWTTFRCDCLRPYGGPACSYEHPAVTFGLENSTSFSSFILSDSLGADFNISFFIRSLKPNGLLLQISNETDPCLTIYLKNGKLKIEMLSTDTVTFPENLVDGRRHLVALSFQGGIVGVHQPDTSGYDVYIGGRPDPDSTDLWGGYFKGCLQDIQLNGHQIEFFQVENYSLPDELNRTQNINLVNGCISDNTCKSEPCQNGGRCIVTWNDFHCSCPANFTGKFCEERVWCESDPCPEATTCIDVPAGYVCLANATFNSSATIEFTTNTSVTRTLGSLLMDFRTRDEDAVLLRAMEEVDSLQIAIKNSSLLVDIRSGNSIEGVSFLSQNAVTDGAWHTISLSMEEPSALSSRWVAHLDGSINMTLQGNAGNLDFLKNNALIVLAENFTGCLGQVKIGGIYLPFTSHLSYPQPEQFQQSSRRTIQLGCTGADVCASSPCSNAGTCRDLFNSFSCACSAGWEGLLCESNTDDCQSSPCVHGNCTDRLADFHYSCKCPAQYSGPRCEWPFPPEQCGKNFTCLNGGKCTTETWGANCTCKPGFTGRNCQININKCDPNPCQNGGTCQDSENKFKCLCSASYTGERCDINKGTPGAFFPSPLIEVAVPVACGSLLLLSIGLIFMILTARKRRQSEGTYSPSQQEVAGARLEMDSVLKVPPEERLI

SEQ ID NO: 73 - protein, 1384 aa, Gallus gallus
  MISC_FEATURE: Gallus gallus CRB2 isoform 2
MLTNKLFVFSTGPSYSENDSSCSSSPCENGGSCKDLEAGYQCICPMHPIAYMGINCELLYDACTKHDCPAHMICNKTPGLPEYECICMPGFTGIDCSININECESNPCKDPRFECVDSVSGYACKCQTGLNGEGCQNSVCSSHLCLNNGTCVEGPGDYACICQPGFTGAHCKDNIDECASNPCQNGAICRDRVNEYSCFCVPGFQGYNCEIDINECASRPCKNNGTCLNEMDHYLCKCIPGYTGYQGIQCEVDINECISQPCQHNGTCHDLINRLTRSYQCDCSDTGFEGDHCELDILECASEPCLNNATCVEGIKNYSCACWTGYTGQHCEEDVNECATDPCHNGGVCFYSQAAGFLCWCQPGFAGRLCVIESIYRNASLYPSLLHACTNVGNLYFHFKGETCFTNINECESQPCQNGGHCVDLVDGFLCHCLPGYSGYYCNALRESTASTHSSLFFTQFTSAGLERTAISLVQCEEGPCKNGAVCEDGIADYTCHCAPSQDGIVWGGKNCSVKLTGCQTHDCQNEALCIPTYQAESHGHLCQCQPGFYDATCSTPTTFSFASRGYLLIELPVNNQSRREVAGEQLASVSLRFRTTLPSAILFYRGHEAEYLFLELLDGILRTELKRQDEYLLLLEELRVDDGHWHKVEVVLQNTVQLKLWHDSCDAGVCMQSSPIPHNATPIPHAFLSVYIGGAQDPLANNTQSQQGFVGCLEDLQVDAEAVLPVALPVSEVSSVTQGCDRTEWCLSEPCFHGGLCVDLWTTFRCDCLRPYGGPACSYEHPAVTFGLENSTSFSSFILSDSLGADFNISFFIRSLKPNGLLLQISNETDPCLTIYLKNGKLKIEMLSTDTVTFPENLVDGRRHLVALSFQGGIVGVHQPDTYVELGQLVGRPLLAGYDVYIGGRPDPDSTDLWGGYFKGCLQDIQLNGHQIEFFQVENYSLPDELNRTQNINLVNGCISDNTCKSEPCQNGGRCIVTWNDFHCSCPANFTGKFCEERVWCESDPCPEATTCIDVPAGYVCLANATFNSSATIEFTTNTSVTRTLGSLLMDFRTRDEDAVLLRAMEEVDSLQIAIKNSSLLVDIRSGNSIEGVSFLSQNAVTDGAWHTISLSMEEPSALSSRWVAHLDGSINMTLQGNAGNLDFLKNNALIVLAENFTGCLGQVKIGGIYLPFTSHLSYPQPEQFQQSSRRTIQLGCTGADVCASSPCSNAGTCRDLFNSFSCACSAGWEGLLCESNTDDCQSSPCVHGNCTDRLADFQCECFRGYIGKKCDINVDDCVRHQCQNGATCIDGVYGYSCKCPAQYSGPRCDYRARISNCEKSPSTNIWLLWKSSETFPFSNCVKAFPRKTNDCAYDPCQNGGKCTTETWGANCTCKPGFTGRNC

SEQ ID NO: 74 - protein, 1255 aa, Taeniopygia guttata
  MISC_FEATURE: Taeniopygia guttata CRB2 isoform 1
CLCRPGFSGATCGHDIDECASGPCRNGAICRDSAGEYSCFCVPGFQGSHCEIDIDECASRPCRNQGTCLNHMDRYECRCAPGYAGVNCDTEIDECASDPCQNGALCNDHVGFYTCTCAPGYQGAQCEVDINECESQPCQSNGTCHDLINSYHCDCSDTGFEGTHCELDILECASDPCHNSATCLEGIKGYSCVCWPGYTGQECEEDMDECVTEPCHNGGLCLERSNPAHYGTQPHFPSNFSYSQAAGFLCQCQPGFTGVECAVNINECEEGPCKNGAVCEDGIADYSCHCAPAQDGIMWGGKNCSVQLTGCQTHDCQNEALCIPTYQAESHGHLCQCQPGFSDATCSTPTTFSFASRGHLLIELPENSASGRDAGGASVSLRFRTTLPSAVLFYRGREAEYLFLELLDGILHAELKREDVGYPLLLKGLRVVDGQWHKWEVVVHSTVQLKLWHGSCEAGVCLQSSPVPPGTAVIPQAFLNLYIGGAEHPMANNTRSQQGFVGCLEDLQVDAEAVLPADLPLGESSPARPGCDRTEWCLSRPCFHGGLCVDLWATFRCDCARPYGGPACSYERPAATFGLENSTSFASFTLSDSFGADFNLSFFLRSRKPDGLLLQVCNGTGPCLTLYLRDGQLSIEMSPTDTVTFPGNVVDGRRHLIALSFQGGSVGALQSDSFVELGQLPAQALGAGSEVFIGGHPNPGSAELWGGYFKGCLQDIQLNNHQIQFFQVENDSLPEELNRTQTGNLVNGCISDDTCKSEPCQNGGRCIVTWNDFHCSCPANFTGKFCEEKVWCESDPCPEATTCIDVVAGYVCLANATFNSYAAVEFTTSTSVTRTLSSLHMDFRTRDEDAVLLQAVEEVDSLQVAIKNSSLLVDIRTGNGIEGVSFLSPQPVTDGAWHSVSVSMEEPAALSSRWLLRLDGAVNVTLQGSAGSLDFLKNNVSVVLAENFTGCLGRVQIGGIFLPFPPHQPYPQAEQFQRASPGSVQLGCSGADVCASSPCLNAATCEDLFNAFRCGCSAGWAGQRCEANIDDCQPSPCVHGACVDAVADFQCECFRGFIGKRCDINVDDCVRHQCLNGATCIDGVYGYSCKCPPQYSGPRCDYLVLALSFLGPSCTNFTCLNGGRCITESWGANCSCRPGFTGRNCQININECDPNPCQNGGTCQDSENRYECVCSASYTGERCDINMLDFGHSSVVGAVGAAGAALLLALVIATAIAMKRRRATQGTYSPSRQEKDGARVEMWNVIKMPPTERLI

SEQ ID NO: 75 - protein, 1404 aa, Pelodiscus sinensis
  MISC_FEATURE: Pelodiscus sinensis CRB2 isoform 1
MLAMELKGILASVYHAVLLLPFSLLLWGPSSSNAAGSCSPSPCQNGGSCEDLEGGYRCLCPQQPVAYRGANCELLSSVCSVHNCPPDWLCTETAGHQGYECTCGPDLPGTECPMAAHACESNPCHGPPWECVASARGYICQCPTAPSGDGCRLEGSWCSSRPCQNNGTCTEGAGGYACRCHAGHAGPHCEEDVDECASSPCQNGAICLDGAAEYQCFCVPGFQGHRCEIDIDECASRPCEHNGTCRNERDHYVCTCVPGYAGVNCEAEIDECNSDPCQNGGTCTDRVAFYACACAPGYEGPQCQVDIDECASQPCSNGGICHDRVGSYQCDCGDTGFEGAHCELDILECASQPCWNGATCLEGVREYSCACWPGYAGQRCEEDVDACASQPCHNGGVCLERSNRTYYGTQPDFPPAFGYSHAAGFLCRCQPGFSGESCSVNVDECASQPCQNGGSCMDLANSFLCRCLPGYAGVECAVDIDECKDGPCQNGATCEDAIADYFCYCAPGQDGIQWGGKNCSVALMGCQTHDCQNEALCIPTYHAETHGRLCQCQPGFYDATCSTSTTFSFSSPGYHLLQLPLKNNGSSKDVAGDVTRVSLRFRTTLPNAILVYRGNEAEYLFLELSDGMLHAGLRRDDAESSLDLKGLRVDDGQWHKAEVLLQDSLELRLWHGACKTGVCLQDIPTGNSAAAPFPAFLNTYIGGVDGDLTNTTRSRESFIGCLEDLEIDDQIILPFDIPHHESSPVELGCNRTEWCHSQPCSQRGQCVDLWVTFRCDCARPYEGQTCSHEYPAGTFGLEDSSSFASFTIVDNPGANFNVSFFIRTRKPSGLVLQISNGTAPCLVVYLKNGQLQIATLSTNTVTFAENLADGRRHLAENYSRPQKVYMGQTTNLTQGCISDDTCKSGPCHNGGTCTVTWNDFHCHCPANFTGKTCEERVWCAGDPCPKATFCVDVPAGYVCLANATFHGNTSVEFTTNASVTRALTSLYLDFKTRDKDAFLLWATEEVDSLQITIQNSTLLVALRSGNSIEGVSFLSQTPIADGSWHRVSLSMEEPSVLSSRWLVLLDGSVNGTLQGSAGNLDFLKSNALIVLAENYTGCLGHVNVGGVYLPFTGHLAYPQPEQFLQSSSGRVQLGCTGADVCTSSPCFHAGTCEDLFNSFQCACSAGWEGPLCESNIDDCKSSPCVHGDCMDSVADFQCDCHRGYIGKRCHINVDDCVRHQCLNGATCVDGVYSYSCKCPPQYSGPRCEWPFPPQQCGKNFTCLNGGKCTSGTWGANCTCKPGFTGRNCQININECEPNPCQNGGTCQDSVNKYECVCSASYTGERCDVDKGTPGAFFPFPLIEVAVPVACGCLLLLSIGLIFTILTARKRRQSEGTYSPSQQEVAGARLEMDSVLKVPPEERLI

SEQ ID NO: 76 - protein, 1428 aa, Xenopus tropicalis
  MISC_FEATURE: Xenopus tropicalis CRB2 isoform 1
GLAQTCVSSPCLNGGTCQETASGFTCLCPAEPLAFTGTTCGDLYDACAIDRCPSTHSCQSTPGHPHFQCVCQPGLNCTNECQRNSCPFQNFQCTVGEDSFMCKCQSGYGGVDCNFEVSPCFQNPCQNNATCLAEGDSFRCVCEPGFTGQECEVNVNECASNPCQNEALCVDKVDRYMCFCVPGFQGHHCEIDINECASRPCQNNGTCMNQLDQYECACANGYTGKNARNTINFLVVSPLILHGGKESYHYLYNCLATSSAALCIFFLPECARSKCSMLIQCVAIIKKFRCDCSNTGFVGGRCEVEILECDSNPCQNNGTCMERVNGYECLCWKGYSGIHCEIDDNECFEEPCVNGGLCLELSNQSYYGTEPEFNKFSYSQAAGYLCRCQQGFTGPNCSVNIDECESWPCLNGGTCTDLINGFLCNCASGYTGFDCSINIDECKDSPCKNGASCEDGVADYSCICPPAAQDGTVWGGKNCSVMLIGCLEHSCQNAAECIPLYTGQSHSYTCKCQPGFVGNNCSTPTTFSFLSQGYLMYDSPLSNESYQSNMSVRFRTTLPDMVLMYRGDEDSFLALEIYNGFLHMRLKGNGRLFPLVIDDYKVNDGHWHNVEVDLLSNSFLKISLFHNDCRNGLCSQKQTPTEGFDPYLPESFRSLYIGGLIQESLIKNTLSQQNFTGCLEDLVVDLVTQLPHNVSSDRSFGMVLGCKKAEVCHPNPCHNGANCIDLWSSFTCECIRPFKGSTCMQEYIAGTFFREGIPSHSYFELNQDFGTSFNISAFIRTLKSNGLLLQISYGTTPYFRTYLNNSWIHIETLSAQPLVFKKNVSDGMKHFISISVREGNVTVTDLQQEVYLGMLPPVIITKGDAVHVGGLATADSTIFWGGYFKGCVQDLRINNDHLEFFHPEHINVQETLYFGNNTNVTENCISDDVCHQGPCRNEGNCSVTWNDFVCSCPANFTGKRCEEPVWCRRSPCLPGSTCVDVPKGFVCLANVSFQGHSSAVFTPIISEEHNLTSISLAFRTRDRDAVLLQSSKNVDSVLIEIQGGYLFVDLQSGNNVDGVQLNGTIDVADAIWHRVVITMERATKVNSHWTFQLDDSVQKKFQWEGDNLNFMRNNISIVLAEGYTGCLGDVSIGGIYLPFTDHVLPQQDQFIRKSDALELGCRGADVCSESPCLHGGTCQDLFNSFSCTCRIGWNGHRCEINIDDCKSSPCLHGFCIDLEADYQCSCEAGYTSRNCEININDCQHHQCLNGGTCVDGVNNYTCKCPANYAGTFCQWPFPPEQCNKNITCFNGGRCNSGIWGANCTCRPGFSGRRCEINVNDCESNPCLNGGTCQDSVNTFKCICNSSFSGVRCEKSDAASMFPFPLVGVAVPVTCGVLLLLVIGVIFMVLTARKRRQSEGTYSPSQQEVAGARLEMDSVLKVPPEERLI

SEQ ID NO: 77 - protein, 2146 aa, Drosophila melanogaster
  MISC_FEATURE: Drosophila melanogaster CRB
MAKIANASLSQQQKQRQAETATTTTTTVAASVETATTTARSRDRTKSAAQITSHLLKRAISVYSSPQWIPLFILIYLATDVASVAVPTKEAYFNGSTYLRLTTPMPIWDHSAISFRSCRGGEILAQQYNKNSIVISVLNDFLQISLAGPAVHGPNNRLDVKLPYQLLDNRWHTLQFKYEYGNLYLHVDRAASIFANSTYNSQFLTNQDIGYKDAILILGNSFSGCLLDGPGLQFVNNSTVQNVVFGHCPLTPGPCSDHDLFTRLPDNFCLNDPCMGHGTCSSSPEGYECRCTARYSGKNCQKDNGSPCAKNPCENGGSCLENSRGDYQCFCDPNHSGQHCETEVNIHPLCQTNPCLNNGACVVIGGSGALTCECPKGYAGARCEVDTDECASQPCQNNGSCIDRINGFSCDCSGTGYTGAFCQTNVDECDKNPCLNGGRCFDTYGWYTCQCLDGWGGEICDRPMTCQTQQCLNGGTCLDKPIGFQCLCPPEYTGELCQIAPSCAQQCPIDSECVGGKCVCKPGSSGYNCQTSTGDGASALALTPINCNATNGKCLNGGTCSMNGTHCYCAVGYSGDRCEKAENCSPLNCQEPMVCVQNQCLCPENKVCNQCATQPCQNGGECVDLPNGDYECKCTRGWTGRTCGNDVDECTLHPKICGNGICKNEKGSYKCYCTPGFTGVHCDSDVDECLSFPCLNGATCHNKINAYECVCQPGYEGENCEVDIDECGSNPCSNGSTCIDRINNFTCNCIPGMTGRICDIDIDDCVGDPCLNGGQCIDQLGGFRCDCSGTGYEGENCELNIDECLSNPCTNGAKCLDRVKDYFCDCHNGYKGKNCEQDINECESNPCQYNGNCLERSNITLYQMSRITDLPKVFSQPFSFENASGYECVCVPGIIGKNCEININECDSNPCSKHGNCNDGIGTYTCECEPGFEGTHCEINIDECDRYNPCQRGTCYDQIDDYDCDCDANYGGKNCSVLLKGCDQNPCLNGGACLPYLINEVTHLYNCTCENGFQGDKCEKTTTLSMVATSLISVTTEREEGYDINLQFRTTLPNGVLAFGTTGEKNEPVSYILELINGRLNLHSSLLNKWEGVFIGSKLNDSNWHKVFVAINTSHLVLSANDEQAIFPVGSYETANNSQPSFPRTYLGGTIPNLKSYLRHLTHQPSAFVGCMQDIMVNGKWIFPDEQDANISYTKLENVQSGCPRTEQCKPNPCHSNGECTDLWHTFACHCPRPFFGHTCQHNMTAATFGHENTTHSAVIVETTDVARRAIRSILDISMFIRTREPTGQVFYLGTDPRKAPTKNIGDSYVAAKLHGGELLVKMQFSGTPEAYTVGGQKLDNGYNHLIEVVRNQTLVQVKLNGTEYFRKTLSTTGLLDAQVLYLGGPAPTRESLLGATTEPGIIPVPGAGIPIEDTTVPKEADDSRDYFKGIIQDVKVSNGSLNLIVEMYSLNVTDVQVNAKPLGAVTIDRASVLPGEVSDDLCRKNPCLHNAECRNTWNDYTCKCPNGYKGKNCQEIEFCQHVTCPGQSLCQNLDDGYECVTNTTFTGQERSPLAFFYFQEQQSDDIVSEASPKQTLKPVIDIAFRTRAGGTLLYIDNVDGFFEIGVNGGRVTITWKLSALHFGESARFEKENTDGEWSRIYLRAHNSKLEGGWKGWESMVDPTPAFSTDIDQAAFQSLIATSTQVYLGGMPESRQARGSTLSAQQGSQFKGCVGEARVGDLLLPYFSMAELYSRTNVSVQQKAQFRLNATRPEEGCILCFQSDCKNDGFCQSPSDEYACTCQPGFEGDDCGTDIDECLNTECLNNGTCINQVAAFFCQCQPGFEGQHCEQNIDECADQPCHNGGNCTDLIASYVCDCPEDYMGPQCDVLKQMTCENEPCRNGSTCQNGFNASTGNNFTCTCVPGFEGPLCDIPFCEITPCDNGGLCLTTGAVPMCKCSLGYTGRLCEQDINECESNPCQNGGQCKDLVGRYECDCQGTGFEGIRCENDIDECNMEGDYCGGLGRCFNKPGSFQCICQKPYCGAYCNFTDPCNATDLCSNGGRCVESCGAKPDYYCECPEGFAGKNCTAPITAKEDGPSTTDIAIIVIPVVVVLLLIAGALLGTFLVMARNKRATRGTYSPSAQEYCNPRLEMDNVLKPPPEERLI

SEQ ID NO: 78 - protein, 2035 aa, Daphnia pulex
  MISC_FEATURE: Daphnia pulex CRB
MTLSLLPANQGGRLSLSLSADANEFTTEAGFDLADNRWHDVDLRFHEDFLQIRLDDDWTPVVNASFVQGSTLFRRDDAEAKAMTVGSGFTGCLLQGPSFPLTSIDQHLRVACPIPLGPEVCSNATTDPCWTRPCRNFGKCSPSSGNDQGFECRCSLRYIGDRCQHDLGSLCQRPEFSCLNGGSCHELVTGNGTSCICPPNFTGSLCENAMDLPRCSGETQSCLNGGTCFQPTNGEVLCLCPAGFTGPRCSDNTDDCLHPSVCLNGGTCLDGINNFTCTCNGYRYQGERCETKINHCLLDTCQNGGTCFDRFGSYVCQCAAGFSGNECQLEMASRDLRPCLNGATCVDGLANYTCLCPAGFEGRDCQTDVDECQLPTTLCGIHSTTCTDLVGDYRCVCEPGWTGRHCDVDIDECADSPCLNNGTCLNQLNAFQCQCPNGFSGERCEVNRDDCLPDLCRNNGTCCRCPVGFTGHLCTENINDCVANPCQNGGSCVDGIGNYTCSCPPGFTGRNCSEDIDECAVLKPCVYGICQNTIGSYQCYCRPGFSGDNCNLEFDECLSHPCQNNGTCNNLINGYECVCAPGFTGKDCDVNINECESNPCQNNGTCIDGIAAYNCICLAGFTGPRCEVNIDECQSSPCLNDGLCLDGVNSYACDCNDTGFHGLHCEVNVDDCLSAPCVHGSQCVDLVKDYQCQCHPGYEGKNCEQDVNECEPVSQPCRNDAECLERSNRTLYEPGQVFYSETEPFSYNISGGYLCRCLPGFEGVDCQINIDECALATAASPRGQSPCKFGTCLDGINNYTCQCLPGYEGDDCELEIDECGRYEPCQNGATCSDRVADYQCLCPSNYGGKNCSVELLGCIDVSCLHGGTCAPYLEDETIHKFTCQCPFGFHGQLCQHATTMSFNGSSFMPVQTNREEGYDLSFRFRTTLPKGLLAVGQGQTYYRLELLNGQLNLHSSLLNKWEGVFLGSNLNDAEWQSVRVRFNFTHLHLAVNQLEALYPINPVESINSTETSFGMTVLGGATSFLRILAQGLPFFIGCMENVVVNGQWVIPSPSPSGIEPGSTANSQNMLHLPGMGVEMGCPRTDHCRPNPCQNDGTCNDLWTFFNCSCQRPFLGDTCQFSYTAATFGHENATSSLVSVSITPQERLALSNSMDISLFVRTREPTGLIFYLGTPPADSGGPSYVAAELQGGRLLVVVDLGDGELIFPAASSPPINDGNSHLVQVIRDRLQLRVKINGTVYLNDSLTSFRPLQAQVLFLGGLPPSARLKRRQTTLPTSISSQLASGQQQPIGISVQLNNNNNVLEGRNFKGILQDIQIKSGNITRIVEIFPLEVPSRNELPDSLGTVERTGQVLQGVVSDNNCRTDPCFNGGNCTITWNDFQCICPPGFKGKTCAELEFCAIHQCPVGGQCHNLNDGYECLSSATFNGVNSTVEYTSLGIDGSSTGLHQTVEFSFRSKQGGTVLTIQNEASAHVRFMRLDIEGRGVVIRWIAKSGLVVNESLYELPEALDGSWHSVSLNLPGNFSLAELVAPEGQIILGGSGVETVTVHSLVERQVPDETTILPDEQNEENAEQPTPTGPAVMLILPDSVPYRGCLNEFRVGGLLLPFFSTSDLLSDPSARKFRPISTSQLDNLELECRLCYDHECQNGAKCLDPLANYTCDCLAGYQGDLCQVNIDECVDHLCVNGDCLDGVANYTCQCRAGWTGWLCDEDINECEPDPCQNNGTCDNLIGRYFCNCTEDFVGVDCEKPRVVTCANEPCLNSANCTDLFDLVTLLANNYTCHCPFGFDGINCENPINYCSVLDPCRNGAFCTGVSFEPGYICECDEGFTGDNCEIDINECAQRPCLNGGRCIDGVNNFTCDCTSTGYEGYLCEVDVDECRRDDPCVRGRCLNSPGSYSCLCESEDDCGRHCDRKDPCRIESVCYNGAKCTSYCDDLDKLTSLPIYRCSCSEGYEGSDCSMQSVSQLEPNLKLVAIIVPIVAALLLIALVGFVVFVMMARNKRATRGTYSPSRQEMFSPRVEMGQVMKPPPEERLI

SEQ ID NO: 79 - protein, 2181 aa, Acyrthosiphon pisum
  MISC_FEATURE: Acyrthosiphon pisum CRB
  misc_feature (1021)..(1022): Xaa can be any naturally occurring amino acid
MIESKQRMLPLDFGWRSGGADREGYFNSSSWLNLFPPISLYKHIGFSFRTCSGGQIFSQTQDLPYNQISVDVLHDGLLFTTFLQNKHFESKIQGDFFDNSWHNVNFIYKLGELTISVDSLQQVIANSTFNSEILNSEITTDQSMLRVGDGFEGCLLEGPNFIFNSSLNQAYKVVWGHCPLNSQSCTGIDYCSHAPCMMHGVCVPRQNKYHCICQPRYSGNNCEIDNGSPCAKQNNRCMHGLCEEINYGNDFMCHCDQGFTGKFCEIELSAHVCDNNPCRNNGTCKLTSGGKSYECSCAPGFKGDDCEININECLSSPCQHGGVCIDGVNNYTCACSKTGYKGINCETNINECEINPCSNQGICFDNYGSYTCQCQSGFGGINCDIELNECVSNPCQNGGQCRDQVGTYECRCALGFIGRNCEINVDDCESAVCPTNSICVDGVASHSCHCKSGYTGVPPNCSEITVCSSHPCQNGGSCGLLPNGQFNCSCSLGYTGAFCEHGNIVARSHADDVCVIMPCLNSGTCISQGSNYECKCPAGFTGRNCEMTMKCNATPCQHFVSCRDYAGGYYCECEPGWSGQQCNQRDPACSPNTCAHGGTCTLLAGQADPFHCDCPPGFTGQTCQIDIDECMSKPCLNGGICHDLINGFRCNCTDNYMGAYCQLPFDACTKNPSPCLNNGTCLHKTSSLKDYYCKCSPGFEGKNCEGNIDECKTGTCPVGKVCIDGINTYECECPEGYTGENCSKILNDCRDNLCKNNSTCIEDVDGYTCRCMSGFTGMHCDQDINECEVNKEVCNYGICVNTNGSYQCFCRPGFSGDNCDVDFDECLSQPCYHGATCENKINGFNCICPPGYTGKVCSIDINECSSNPCLNGATCIDNIASFTCSCPPGIVGKLCETNIDDCESSPCQNMGLCIDGLNSYECNCTNTGFEGNHCELNINDCIHDQCENNGTCIDGIKDYSCKCYTGYTGKNCEVDINDCENNPCQYGGTCLEHSNISLYNQKDNNNLSAIFQQEFSYATAXXFECLCLPGTTGIKCEIDINECDSNPCNYGACENKINGFICACEDGYEGRYCETEINECERFKPCDHGTCMDRRAGYYCDCAPKYGGKNCSVELFGCQDHHCLNNGTCKPYLIDEIEHRYNCSCPYGFHGHICDKTTTMSLTGESRIVVNTTRDEGYDISFRFKTTLPSGLLAIGGGSTFYILELVKGRLNLHSSLLNKWEGVFIGSELNNSQWQKVFVAINSSHLVLSANEEQTIYPINLNEGANPTHTSFPTTYVGGTISNLRLLPHGPPYFTGCIENLLINGQWVLPDDKVGSTIGLTNVDIGCQRNDQCFPNPCHNSGHCTDLWKTFSCTCERPYLGNTCQYSFPAATFGHENITTGLVTVNVFAVAKRAVRNIVDISMFIRTRQTRGAIFYLGSMPGMVTFSEETHIAAELEGGELLVRIQFNATPESYTVGGVKLDDGHDHLIQVVRNITLVQVKINGTEYFRKTISATGQLDVQVLYLGGFPSSKPSRRDLSDPLIVMDNILPRPNTIERHIRQTTADKFEGIPHFKGIIQDVQISNGSQTMVVEFYPLGIQNKDLVVPKAFGSVSFNQDEIAQGVLSDDTCRSNPCHNDGVCSVTWNDFTCKCPLGYKGKQCQEMEFCQLQDCPLGSECRNLNHGYECVAKITLDSRNTTEPLLQYNFIKGQQVIPLTHIEVNYRTRTGGSIMYVSNKKNSNDSEYTFFTMIAYKDRYETSAQRSFRFRGCLGEIRIGGLLLPYFTPTELNTNNQTDHFVMLSHNSTTQNFDLDCLLCYDYECKNGGRCKKATESYVCECQPGYEADDCSANINECLSNECRNSAECIDGIANYTCQCKIGWMGTFCEIDINECESNPCHHNGICIDQLGDFECNCTDDYEGKTCEQLKLVTCDNLPCKNGANCFKIPDQFGNNYTCSCLEGFSGTTCDTAFCDTNECQNNGLCKKEESPFCECPLGFKGHLCEQNIDDCFDNDNQQKCQHGGQCIDGINEFTCNCTDTGYTGDDCSIDIDECFDLNIQCGHRGECKNTPGSFICACEKGYCGNYCDLINPCLPENPCNNGGFCQEHCTDVIVYECQCANGYVGQNCTELPIIHNYADIALIVGPILLILLIGGMGSLLVLLMMARKKRATRGTYSPSCQEYCNPRVELDNVLKPPPEERLI

SEQ ID NO: 80 - protein, 2020 aa, Acromyrmex echinatior
  MISC_FEATURE: Acromyrmex echinatior CRB
MVANTTYNSAILTLPDYNVNSSLIVGEGFRGCILQGPGILFNNSINNGAVFGPCSDIKGCGTSGLGTGVTSATMATMDFCHHEPCMMHGKCVSRQDRYECHCYARYSGNNCQIDNGSPCQNTPCRNGGTCSEDVRGDFSCSCKPGFTGSFCESQLGVRLCEQNPCRNDGICMALTDSEYKCQCQPGWTGKKCETNINECASNPCKNGGICIDGINNYTCRCDRTGYEGLNCDVDIDECEANPCLNNGICYDYYGAYICHCPTGFEGQNCELNLNECLIEPCANGGKCIDDVGTYHCECIPGFTGRHCELRGLCENAACPPNSICVEDSHGPQCVCNPGFMGNPPNCTVNYCASNPCANGGTCTSGKDGFNCTCLPEWRGKNCQIDIDECLSQPCQNGGTCIDRVNGYTCNCTRDFVGDNCEREYDACVINPCQNNGTCMLMPRSKREFVCECLHGFEGKVCDVNIDDCIDVMCPDDKICVDGIANYECKCREGYRDPNCTLIVDHCATKPCNNNSTCIDLGDRGFECKCQYCDLDVNECELHGNSLCNNGICINTEGSYNCFCRPGFSGDHCDINIDECLCGPCKNNATCLDGINMFQCVCQPGYTGKTCEIDVNECDSNPCHNGAQCVNGIASYTCVCPVGFLGVNCEINVDECESSPCMNQGKCIDGINGYTCDCSDTGFEGLHCENNIDECLPQPCVNGGLCLDDIKSYKCQCYTGYTGKNCEIDVNECESSPCQYNGTCLERSNKNLYKSEALNLPAIFTQEFNYTNASGYECLCVQGVTGKNCEVNINECDSNPCGPGTCMDRIGGYTCDCDEGYEGDHCQHEIDECKRYSPCEHGVCTDGRADYFCTCESEYGGKNCSVKLMGCQGNACQNGGTCWPYLVDETIHKFNCTCPNGYHGEVCDYVTTMSLSGSSYVLVNTTRDEGYDIQFRFRTTLPNGLLAIGRGVTIYILQLVNGKLNIHSSILNKWDGVFVGSGLNDSNWQKAFVAINATHLVLSANEEQTIYPISPNEGSNSSSFLRRLSRLSSFTFFVGCMEDVVINGEWVYSGTTSKTMYMEDVEAGCPREAQCSPNPCKNGGHCTDRWREFYCKCERPYLGHTCQYNMTAATFGYENITNGYVTVRVSDAARRTVSSVVDISMFIRTRESYGDIFYLGTEPDSQIDQKSQEKTYIAAQLEGGELRVRIQFNGTEAYSVGGVKLNDGNNHLIQVVRNVTLVQVKINDTEYFRKTISATGDLNVTVFYLGGLPQSSRYIRQVDSRQMEVQQTPQINFKGIIQDVKISNGTKTMVVEFFPLKAQDIPALIQFGNVSFDPEKVLEGVVTDDVCVSNPCNHNGTCHVTWNDFWCQCPRGYTGKTCQEMEFCQLQDCPAGSRCQNLDDGYECIANATFDGVSTLFTYTYGRVTDTASDLPLDTIEITYRSNTGGTLLHIAPHMGDQHFTVFIFKDNVTVSWRLDLENQNNVSFGKSQPDGNWTSLLIKLNNNSVECGYANPTEEQPRMSLNFSFQLWYDLLITGTVTLGGISSSALSDKDTYLTVGSRPENRNGIEGNSVDYEHRLTTTMPPHSMISGEPFKGCLGEVRIGSILLHYFTYEEVYQNANFTPLEYLELRDNDNATHRDSIGCQLCFDMDCQNNGYCFDKANSYVCECPAGYAEDDCSFNIDECIDNKCQNGATCVDGIANYTCVCKNGWQGWLCDSDINECVTLSPCKHEGVCVNLPGSFRCECPDQFTGELCESFRLITCKNEPCKSGATTSCLDEPNPKTGNNFTCNCAPGYDGPTCDTPYCFHTKCQNGGRCEFLIPYKAPKCICPVGYTGTYCEINIDDCAVDSEGNGPCQNDGKCYDGVNKYVCDCQGTGYSGINCSIDVNECQDLEIDCGHGKCENLPGIYQCICDDGYCGYNCGMANPCQDDFCHNGGTCECGDDGEYICRCTPNYTGRNCTELEYNYLSGQALDIVVIVGPIVGCLLLIAIVSLIALFMMARKKRATRGTYSPSAQEFSNPRVEMDNVMKPPPEERLI

SEQ ID NO: 81 - protein, 2623 aa, Branchiostoma floridae
  MISC_FEATURE: Branchiostoma floridae CRB2 isoform 1
MNCWQLGAAALSAATKYMCSGSTYNIVNPKKKKYTVNPSLSLLAVVAAQTTQAPTPSANAFFNGFNSYAVLPNTLQITSTLTSFSFRTCNGGQLLRQEGSNGDYIELSLIASGGVLRFSFRKAGGRGEDYVDLGSGLNTNQMWHTVDLEYLVGNLTLSVDGEKITVASQTVRSYVLDIDLSGSAGVEVGRGLIGCVYAGPGVQLTTATSQSNVQWGSCPLENNEGCDGPVDTDACVSHPCENGGICVDEIQNYTCICTDRYTGRNCEIDTGPLCESPANVCYNGGVCQEQQNGNYTTCVCRDGWAGPRCTESPCVSEPCMNGATCLNVTGGYQCTCPDGFAGVNCEININECATAPCKNGGQCTDSINGVICDCAGTGYEGPFCQSDVNECNNDPCQNSGTCFNRPGGFTCQCAQGWDGDVCDNELDECISDPCQNGATCEDRQGSYFCSCVSGFEGTNCETSQACQAQPCNPEEDCFPEGLNYRCECKPGYDGSAGNCRDIDECASNPCRNRGTCNNYINYYNCSCRDGYNGYNCEFTDECVLRPNYCRNGATCRDLTASFECICAVGFTGEDCSENIDDCAQNNCQNGATCMDQINDYTCNCLPGFEGDRCQTNIDDCSPDPCENSGTCTDLVNDYRCECTTAWAGKNCTQVVGHKDLHLKSSLVDYIYCISLQANLCEVPNPVVCTDGKVCFISEDGLGTDCQCPLGFTGVNCADNINECDPDPCQNNATCIDGINKFVCNCTSGWQGVTCEEDIDECNPSPCQHDSVCVNTEGSYDCFCRQGYHGKNCELDINECYSEPCQNGATCQDLIAEAKCTCAPGYTGVWCEREILECDSNPCQNGATCIDLIARYNCSCMPGWEGVNCEQEVDECESSPCLNGGQCTDLFNNYTCNCSNTGFLGYDCEVEIRECDSSPCQHGGICNDLINYYNCSCYDGFEGYNCETDIDECASDPCQNGATCTENSAGGNTDWPNAGGYTCTCVPGYAGDNCETDINECDSDPCQNEATCNDLINMYTCDCVLGFRGTNCEENIDECTEYGGNPCQNGAVCTDRINDYDCLCTPGLGGKNCSVTLIGCNVNGCENNSTCVPYLQDEATDTHNYTCNCDNGFVGRNCEKATTLSFDGSGYITVPPQTGPTVTLQIRFRTTLPSGVLAFVGEANHHGILEIVDNKIQLTHFNGSVKRSVEVNKVISDGEWHDVTARIVENGTMSVCVDGSNCNDGNVGQTVDFGDLNVGGVDNALLALTTSRKNYVGCVEDIVRDGHAIVAADYVSGSIAEGCDRKDQCNPDPCSGKGVCTDEWIQYTCECERPYTGNNCNYTFSTGTFSNEELSSFANFVVPRSSSDPFKVSMFFRTRKPDGLLMFTGEPGIAPGSPPEDANYVAVQLVNGRIRVDVKEEGQTANQPKSYTLGARLADGEFKFVDVSIDGESMYINVNDQVSNTITLDNAPNLPGGVLYIAGTDFQNAPNLGLSTTEPFKGCIQDLRYNETRLDFYPLAIPGFQLDSPSLESTGLNNVNDTCVSDDTCASSPCTNGGVCTVTWNDFECDCPIGFTGKNCSETDFCVSNPCPSNSTCNNLDDGFECLTSATFDRDMLEYSTSPSFTAIDNTLQVSFRTRDTDALLLRASGGSTTVQLEIVSGNVRFTYNSAPSAEANFDVSDGEWHTVEVTFLGTVAQLTVDNGAENATANMGQAAPNFDDFAGQDTIQVGSQGGQGYFKGCMENLRVGGVLLPFFESSQILTNASKKFNLKSASSITVGCTSDDVCGPQPCVNGATCADIFNDYNCTCVPGYSDKNCSTNIDECASGPCQNGATCQDAVNEYSCDCVPGYVGDHCETEINECDSSPCQFNSTCIDLVNAFFCNCTTNYTGEFCEVNAAFECICPPGYEGKLCDQEIDYCADQPCQFGATCSNNRQIFDYECTCVPGYTDKNCSTNIDECASDPCENMATCTDLVNGYTCQCTEGWNGTECNVDIDECLTITCENNGSCENLPGSVKCNCAEGYEGDRCELDIDECNTTFPCQNGAACNNSVGTYTCDCTLGYSGHDCDVPVCSGDVCLYGSTCMTNSTHWSCLCAEGYQGLRCDEDFDECQTSPCERSAPCNNTFGSYECLCPLGYAGQNCSDPRCTPDLCANNATCNDSGPDWVCYCEEGFEGMRCNEDIDECMSSPCENGAPCKNTYGSFQCMCPLGYTGQTCETPQCTADLCANNATCNDTGTAWVCHCTEGFEGLQCEEDIDECMSAPCENDALCSNTDGSFQCICPLGYTGKTCVAPKCTADLCANNATCNDTGTAWVCHCTEGFEGVRCENDTNECLDSPCRHDSLCNNTFGSYQCSCSLGYVGRNCETPNCTSDLCSNNGTCDDSGSEWVCTCGEGYEGERCGIRGPCADFPCQNGANCSQNVNANPMTYDCECGYGWEGDTCTQEVDWCASSPCQNNGNCSSINTQGFTCQCEPWLDGPTCEQDKDDCLSNPCLNGATCTDKTGEVGVDCACTPYWKGETCTEDRNECEEPEGEEYRCPLNVTASDCENFLGNFTCVCLSGWAGAYCREEVPTQSQQRDDLALILGLPIAAAILLIIIILLVFLLLMRTKRATRGTYSPSRQEMTGSRGVEMGGMLKPPPEERLI

SEQ ID NO: 82 - protein, 2187 aa, Strongylocentrotus purpuratus
  MISC_FEATURE: Strongylocentrotus purpuratus CRB2 isoform 1
MTDDHSIIVTPNFLVDFVQTFPSLLLCFGGLFSRVVVYQGLVLHTVLSQTEGPQNLVFFNGTATVETNTIFSAQGQITLQFRTCTGGELFSQTNGDQTIAVSINETGSIRIRWNSGSGVMETAVGEGFNDNLWTIVDFVYVGESVVLRVRDEAIELATFIKNPTLLDLALSPVMVLGTGFTGCMEEIVGIDFANAVSWSNARWGVCPLDQDIGCGPQDPCASQPCLNNGVCSSDGIGFTCQCTSRFNGTTCENDLGELCSNPSFALDCVNGACMGDGESNTTFCRCNPGYGGLACNTSSTLCDSNPCGDSGECQTNAAVDGIICHCSAGYAGTLCTLEINDCEVNPCLNGGTCQDGINSFTCDCTGTGYSGTRCETNENECQNSPCQNGAGCSDTNGGYYCTCTAGNIGPNCADNLCSLTPCENGATCSVNEGNITCTCAGGFEGDRCQTDIDECTSQPCQNTGICQDKLNGFECFCPQGYIGTTCETELDECGQQDVNSCLNGATCMDLPVGHSCTCVPGFTDAACGTNIDECASSPCSNNATCVDEVNQFRCECAPGFSGIKCEINIDECASNPCQNGGVCTDEVNGYVCDCSDTGFDGPECNNNIDDCASNPCQNEGTCMDGIKFYNCSCYLGYEGINCGIDINECSPSPCQNGATCLQLSNQTLYEPGNQYSDYVPDVFSYANASGYVCVCLDGFEGVDCEVDIDECASGPCANGATCNDGVNRFDCACANGYDGDFCGNDIDECASSPCANGATCQDSVGAFFCRCPEGYGDTRCDVVLTACIDNTQCLNEAMCNPFFREGAHGFSCICPPGYAGQFCAEDTSASFYGTGQYLEYAFPSALPFQFSFSFSTTIPSGHLLQSFSLGDSLSVEMVDGSLSVTSREDATGESVTITGLGSDLDDGEWHDFEINLINSEPGFMEANVTSDSCQNNICSETGTFNSQLSDFGLVYFGHVPTNYAGPITNNAYTGCMRDVKQTSSDDFIMATNPTEHAESGCSRTLQCDPDPCNGQGECTDLWWTYTCQCRLGYTGPSCETSFVQGTFSFEETTSYAMFETSGYPLSESENTIRLIFRTREQDGLLLYTGSGQDFIVLAIDNSSVIADVSFGGTTGSLRVSDSVSDGRYHSLEFSRQSTNMSLTLDSSLPQTEVLAGSSEPSFDQMFVGGVADFNAVGLPAAVSGSMYFKGCLWDVKYNNYSLEFFPLDIVDFQIDSIPVATNSNVISMCNSDNTCDPEPCESEGICSITWNDFECDCPNGYGGKNCSEETICSVNPCPGGADCLDRDEGYECLTPATFSGSGSMIKYNNSLNTTRELSTITFRLQTRRDVGLILHSSNDVLGYFITIDIQDSKLSIRFFFGTQARSLGTVYEIVPDYSVSDGVYHDVRITFASPEVTVAIDNFNVTEQITFQGGLSDVVNDGSSGIVYLGGTDIANNDYFDVYTSYEGNLEDVRIGTFLLPFFNQSVYNATNEEQFYAIDITDVTIGDAGRDVCASSPCQNGGNCTDQWNAFICICLPGFTGDYCETNIDECDPDPCQFSSTCFDLVNGYNCSCAPGYEGTNCGVDIDECASDPCQNEGACTNGTAEFTCDCPAEFTGRMCEFNISATCDNDPCLNGGTCSDVPNPPAGSDSFTCACVPGYEGARCAYETDYCASVPCQNGATCVSDRTLLAYDCQCVTGYTGNDCQTNIDDCQPDSCLNGAPCVDGVNEFMCDCLAGYTGQSCDINIDECLSNPCYAGTCDDLIDSYTCACPDNYEGVHCDVDVNECMTLDPCQNGGNCSNTEGNYTCTCPEGVFGRNCEIAPCSPNPCQHDGQCSVESPDSVLCNCTLGYVGDVCEVADCSAVVCQNGGLCSVDWGTSSWWCICIEFNEGTRCQFAGPCINPPCQNEGTCSQTLDPADDSFTYQCSCLTGFNDTNCQNEIDWCDSNPCQQEGSNCTSDRVTFTCTCAPGYSGIVCEIKLPDCASNLCLNEATCTDLPYDYECTCVAGYTDKNCGTNIDECVDNLCVNGATCTDLVNGYECNCEGTGFQGTYCEEDILECNATVNPCSNGGTCKEEPGSYKCECVEGYLGPQCLIMDPCFTEGICQNGGTCVLLDATPTYECECADGYSGDNCENTATNINWIIIGASLAAAVVLIIVIILLSFFVCSVRKKRATQGSYSPSRQEMTGSFVEMDNVLKMPPEERLI

SEQ ID NO: 83 - protein, 567 aa, Anolis carolinensis
  MISC_FEATURE: Anolis carolinensis CRB2
SGPCLNGGRCAVTWNDFNCSCPDNFTGKHCEERIWCKSEPCPQATTCIDVASGYVCLASVTFSEHNAVEFTANGTVTRALHSFRLDFRTRDEDATLLRAAEEVDSLLVAVQNSSLWVEIRSGNGVEGASFLGKESVSDGSWHTLTLSMEDPLALSSRWQLHLDKSANATLEGNAGNLDFLRSKTVIVLGENFTGCLGHVDIGGVLLPLSVPVSYPQPEQFLQMDGGASLLGCEGADVCSSGPCRHGGSCQDLFNAFSCACGPGWEGPLCEANVDDCTPNPCVHGECVDEVGDFQCDCHKGYIGKRCQINVDDCVRHKCQNGATCVDEVYSYSCKCPPQFTGPFCEWPFPPEECGKNFTCLNGGKCISGPWGANCTCKPGYTGRKCQININDCEPNPCQNGGTCQDSVNRYRCLCSASFTGERCDIDRGALPGALFPFPFMEVAVPVACGCLLLLLIILVLMVLLTARKRRQSEGTYSPSQQEVAGARLEMDSVLKRPAWAQVSSSTLVGAVGAAGAAVLVAIFGISVVAMKKRRATQGTYSPSRQEKDGARVEMWNVIKLPPLERLI

SEQ ID NO: 84 - protein, 120 aa, Homo sapiens
  MISC_FEATURE: Homo sapiens CRB3 isoform A
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQVGARVPPTPNLKLPPEERLI

SEQ ID NO: 85 - protein, 113 aa, Mus musculus
  MISC_FEATURE: Mus musculus CRB3 isoform A
MATPGLGVLLAFGLPMLPSGWSLTAPDPFTNSTTQPPGDESNGGLSSGAIVAITVVFSILGVLLIAVGLFLLMRKLREKRQTEGTYRPSSEEQVGARAPPPPNLKLPPEERLI

SEQ ID NO: 86 - protein, 124 aa, Callithrix jacchus
  MISC_FEATURE: Callithrix jacchus CRB3 isoform A
MANPGLGLLLALGLPFLLARWGRAWGQVPTSSANESSTVLPTSTSPSSSSSSNGTLSQGAITAIIVVFSILAALLLAVGLALLVRKLREKRQTEGTYRPSSEEQVGARVPPTPNLKLPPEERLI

SEQ ID NO: 87 - protein, 120 aa, Macaca mulatta
  MISC_FEATURE: Macaca mulatta CRB3 isoform A
MANPGLGLLLVLGLPFVLARWGRVWGQRLASSAYDSSTVVPSPTSSSSNGNLRPEAITAIIVVFSILAILLLAVGLALLVWKLREKRQTEGTYRPSSEEQVGARVPPTPNLKLPPEERLI

SEQ ID NO: 88 - protein, 115 aa, Ailuropoda melanoleuca
  MISC_FEATURE: Ailuropoda melanoleuca CRB3 isoform A
VGLLLAFGLPLLPARWGPAWGQTLNPPVNENGTITPSDTGSGSSGALSQGAITAIIVVFSLLAALLLAVGLVLLVRKLREKRQTEGTYRPSSEEQVGARVPPPPNLKLPPEERLI

SEQ ID NO: 89 - protein, 120 aa, Sus scrofa
  MISC_FEATURE: Sus scrofa CRB3 isoform A
MASPGLGLLLALGLPLLLARWGRVWGQTSVSPANASSSFTPSAAGSGSSGGLSQEAITAIIVVFSLLAALLLAVGLALLVRKLREKRQTEGTYRPSSEEQVGARAPPPPNLKLPPEERLI

SEQ ID NO: 90 - protein, 153 aa, Sus scrofa
  MISC_FEATURE: Sus scrofa CRB2 isoform 3
RLPVLPEECSPNITCLSGAPCEGGPQGANCSCQESFAGQRCQIPCEANPCLNGGTCRAAGGVYECICSTRFSGQFCEVVKGLPLPLPFPLLEVAVPAACACLLLLLLGLLSGIMAARKRRQSEGTYSPSQQEVAGARLEMDSVLKVPPEERLI

SEQ ID NO: 91 - protein, 125 aa, Otolemur garnetti
  MISC_FEATURE: Otolemur garnettii CRB3 isoform A
MANPTGLGLLLALGLPLLPARWGRAWGQTSTAPPTSANGSSTVTDAGPALESSVPLRQQEAITAITVVFSILAALLLAVGLALLLRKVCEKRQTEGTYRPSSEEQVGARVPPPPNLKLPPEERLI

SEQ ID NO: 92 - protein, 122 aa, Myotis lucifugus
  MISC_FEATURE: Myotis lucifugus CRB3 isoform A
MASPSLGLLLALGLPLLPARWGRVWGQILPWTGRSWSRIPDTTTTPYPSFNGALSKEATTAIIVVFSLLAALLLAVGLVLLVRKLREKRQTEGTYRPSSEEQVGARAPPPPNLKLPPEERLI

SEQ ID NO: 93 - protein, 113 aa, Loxodonta africana
  MISC_FEATURE: Loxodonta africana CRB3 isoform A
MASPGLGLFLAFGLPLLQAYWGQVWGQRKENSTITPTSPGSSGALSQGAITAIIVVFSILGALLLSVGLVLLVRKLREKRQTEGTYRPSSEEQVGARVPPPPNLKLPPEERLI

SEQ ID NO: 94 - protein, 119 aa, Spermophilus tridecemlineatus
  MISC_FEATURE: Spermophilus tridecemlineatus CRB3 isoform A
MATPALGLLLALGLPLLPALLGRAWGQATTALNTSSGNGTTPPSTPSPRGLSPEAITAIIVVFSILAALLLAMGLVLLVRKLREKRQTEGTYRPSSEEQVGARAPPPPNLKLPPEERLI

SEQ ID NO: 95 - protein, 120 aa, Homo sapiens
  MISC_FEATURE: Homo sapiens CRB3 isoform B
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQFSHAAEARAPQDSKETVQGC

SEQ ID NO: 96 - protein, 113 aa, Equus caballus
  MISC_FEATURE: Equus caballus CRB3 isoform A isoform 1
RRPGLGLLLALGLPLLPARWGQVWGQSSNGTTTTPDPDPGSNRALSQGAITAIIVVFSLLAVLLLAVGLVLLVRKLREKRQTEGTYRPSSEEQVGARVPPPPNLKLPPEERLI

SEQ ID NO: 97 - protein, 157 aa, Equus caballus
  MISC_FEATURE: Equus caballus CRB3 isoform A isoform 2
RSPVLPEECSLNSTCIKGGPCEGGPRGANCSCREGFPGQRWCQTVHMPCEANPCLNGGTCRVAGGLYECICNARFSGRFCEVLKGLPLPLPFPLLEVAVPAACACLLLLLLGLLSGILAARKRRQSEGTYSPSQQEVAGARLEMDSVLKVPPEERLI

SEQ ID NO: 98 - protein, 114 aa, Rattus norvegicus
  MISC_FEATURE: Rattus norvegicus CRB3 isoform A
MATPGLGLLLAFGLPMLPSGWSQETPDSFTNSTTQPPDGGGSNGGLSSEAIVAITVVFSILGTLLIAVGLFLLMRKLREKRQTEGTYRPSSEEQVGARAPPPPNLKLPPEERLI

SEQ ID NO: 99 - protein, 109 aa, Cavia porcellus
  MISC_FEATURE: Cavia porcellus CRB3 isoform A
MATPGLGLFLALGLMLLPARWGRARGENSTSVSPTASSTMDGHTTVGGLSTEGLTAIIVVFSILGALIVRKLREKRQTEGTYRPSVEEQVGARAPPPPNLKLPPEERLI

SEQ ID NO: 100 - protein, 121 aa, Sarcophilus harrisii
  MISC_FEATURE: Sarcophilus harrisii CRB3 isoform A
MASSPGLGLCLALSLQLLNSQPALAPISGDIDYTGYENNTTTPSTAPPASGTLSQGAVTAIITVFSVLGILLLVVALVLLGRKLREKRQTEGTYRPSSEEQVGARAPPPPNLKLPPEERLI

SEQ ID NO: 101 - protein, 99 aa, Cricetulus griseus
  MISC_FEATURE: Cricetulus griseus CRB3 isoform A
MDIFFSFYSTAPDFFTSNVTLPPDSGSNGGLSSEAVVAIIVVFSILGVILLAVLLFLLVRKLREKRQTEGTYRPSSEEQVGARAPPPPNLKLPPEERLI

SEQ ID NO: 102 - protein, 109 aa, Danio rerio
  MISC_FEATURE: Danio rerio CRB3 isoform A isoform 1
MIQQVGLLAGSFLLLLVRNVSAQGENSTMSSFTTSSPESTGPNIVAIVVPTVVLGLLAILTAVLVFLFCVVKKKRQTEGTYRPSAEEQTGARSVEAPDALKLPKEERLI

SEQ ID NO: 103 - protein, 96 aa, Danio rerio
  MISC_FEATURE: Danio rerio CRB3 isoform A isoform 2
MLSSGVVLTGHAFETRMFSDCLFAVSIMSSGSVSDLYMPALFLLVLALALFSCVLRKKRQMEGSYQPSAEERKQVKNRGVEKPGLALPLPKEERLI

SEQ ID NO: 104 - protein, 114 aa, Gasterosteus aculeatus
  MISC_FEATURE: Gasterosteus aculeatus CRB3 isoform A
MAACPDVLVTPGVLVRSVLLLVLSSNPVLGNYTTAASGTTANIPTGSNIAAIVAPTVTLGVLAVVLAVLGWLFCVVKKRRQTEGTYRPSVEEQSGARGVAAPDALKLPKEERLI

SEQ ID NO: 105 - protein, 107 aa, Xenopus tropicalis
  MISC_FEATURE: Xenopus tropicalis CRB3 isoform A
MRTYLLTMEEYRFPLMLIAISSLSLVNAENSTTPAPYKLSESARLAAIIVPCVVGGLILIGILAFIIIKIRERRRTEGTYRPSSEEHKEPRVEPNMALKLPPEERLI

SEQ ID NO: 106 - protein, 95 aa, Tetraodon nigroviridis
  MISC_FEATURE: Tetraodon nigroviridis CRB3 isoform A
MAACPAIPPAAVGSILLLIMSTNPVWGDQRRSYCGLHSHLGCPGHRAGCSRLGLLGGEEEEADRSTYRPSAEEQCGTSCTAPPDALKLPKEERLI

SEQ ID NO: 107 - protein, 130 aa, Strongylocentrotus purpuratus
  MISC_FEATURE: Strongylocentrotus purpuratus CRB3 isoform A
PGSYKCECVEGYLGPQCLIMDPCFTEGICQNGGTCVLLDATPTYECECADGYSGDNCENTATNINWIIIGASLAAAVVLIIVIILLSFFVCSVRKKRATQGSYSPSRQEMTGSFVEMDNVLKMPPEERLI

SEQ ID NO: 108 - protein, 117 aa, Mus musculus
  MISC_FEATURE: Mus musculus CRB3 isoform B
MATPGLGVLLAFGLPMLPSGWSLTAPDPFTNSTTQPPGDESNGGLSSGAIVAITVVFSILGVLLIAVGLFLLMRKLREKRQTEGTYRPSSEEQFSHAAAEARAPQDSKEPVRGCLPI

SEQ ID NO: 109 - protein, 127 aa, Callithrix jacchus
  MISC_FEATURE: Callithrix jacchus CRB3 isoform B
MANPGLGLLLALGLPFLLARWGRAWGQVPTSSANESSTVLPTSTSPSSSSSSNGTLSQGAITAIIVVFSILAALLLAVGLALLVRKLREKRQTEGTYRPSSEEQFSHAAEARAPQDSKETVRGCLPI

SEQ ID NO: 110 - protein, 123 aa, Macaca fascicularis
  MISC_FEATURE: Macaca fascicularis CRB3 isoform B
MANPGLGLLLVLGLPFVLARWGRVWGQRLASSAYDSSTVVPSPTSSSSDGNLSQEAITAIIVVFSILAILLLAVGLALLVWKLREKRQTEGTYRPSSEEQFSHAAEARAPQDSKETVRGCLPI

SEQ ID NO: 111 - protein, 123 aa, Macaca mulatta
  MISC_FEATURE: Macaca mulatta CRB3 isoform B
MANPGLGLLLVLGLPFVLARWGRVWGQRLASSAYDSSTVVPSPTSSSSNGNLSQEAITAIIVVFSILAILLLAVGLALLVWKLREKRQTEGTYRPSSEEQFSHAAEARAPQDSKETVRGCLPI

SEQ ID NO: 112 - protein, 90 aa, Ailuropoda melanoleuca
  MISC_FEATURE: Ailuropoda melanoleuca CRB3 isoform B
NENGTITPSDTGSGSSGALSQGAITAIIVVFSLLAALLLAVGLVLLVRKLREKRQTEGTYRPSSEEQFNHAAEARAPQDSKETVRGCLPI

SEQ ID NO: 113 - protein, 125 aa, Pan troglodytes
  MISC_FEATURE: Pan troglodytes CRB3 isoform B
MANPGLGLLLALGLPFLLARWGRAWGQIQTASANENSTVLPSSTSSSSSSDGNLRPEAITAIIVVFSLLAALLLAVGLALLVRKLREKRQTEGTYRPSSEEQFSHAAEARAPQDSKETVQGCLPI

SEQ ID NO: 114 - protein, 123 aa, Nomascus leucogenys
  MISC_FEATURE: Nomascus leucogenys CRB3 isoform B
MANPGLGLLLALGLPFLLARWGRAWGQISTTSANENSTILPSSTSSSSDGNLPQEAVTAIIVVFSILAALLLAVGLALLVRKLREKRQTEGTYRPSSEEQFSHAAEARAPQDSKETVRGCLPI

SEQ ID NO: 115 - protein, 125 aa, Gorilla gorilla
  MISC_FEATURE: Gorilla gorilla CRB3 isoform B
MANPGLGLLLALGLPFLLARWGRAWGQIQTASANEDSTVLPSSTSSSSSSDGNLRPEATTAIIVVFSLLAALLLAVGLALLVRKLREKRQTEGTYRPSSEEQFSHAAEARAPQDSKETVQGCLPI

SEQ ID NO: 116 - protein, 123 aa, Pongo abelii
  MISC_FEATURE: Pongo abelii CRB3 isoform B
MANPGLGLLLALGLPFLLARWGRAWGQIRTASTNENSTVLPSSTSSSSDSNLPQGAITAIIVVFSILAALLLAVGLALLVWKLREKRQTEGTYRPSSEEQFSHAAEARAPQDSKETVRGCLPI

SEQ ID NO: 117 - protein, 120 aa, Heterocephalus glaber
  MISC_FEATURE: Heterocephalus glaber CRB3 isoform B
MATPGLGLLWVLGLALLPTRWGRAWGENSTSTPASLTQEPNDFSSNGGLSQEGLTAIIVVFSILGALVVVSGLVFMVQKLREKRQTEGTYRPSNEEQFSHAAEARAPQDSKETVRGCLPI

SEQ ID NO: 118 - protein, 123 aa, Brugia malayi
  MISC_FEATURE: Brugia malayi CRB3
AAQFSYRYCHKLLSLLYLLLQLAVLVLIALLGMSEVNSATVSTTTILTSTTEASDDDWNGDKTGTIVVILLVILISLIIAGYIGYRKLKERRRSHGEYRPQFEEYQHAKNLPYLQPPSIEGLI

SEQ ID NO: 119 - protein, 100 aa, Caenorhabditis elegans
  MISC_FEATURE: Caenorhabditis elegans CRB3
MASNSTVGMVTEATVSLIEAVSQEAVEASNKGGGLSGGAIAGIVIAVVIGVLLIGVVGFFAFKYVKDRRKNHGEYRPQFEEQHHAKDLPYLQPPNVEGLI

SEQ ID NO: 120 - protein, 103 aa, Caenorhabditis remanei
  MISC_FEATURE: Caenorhabditis remanei CRB3
MASNSTISGSNFVDDNKVSLIDAVSAVDSASSSGGGGLSGGAIAGIVIAVVVGVLLLGVLGFFAFKYVKDRRKNHGEYRPQFEEQHHAKDLPYLQPPNLEGLI

SEQ ID NO: 121 - DNA, 594 bp, cytomegalovirus
  misc_feature: CMV promoter including BGLII restriction site at 5' end
agatctgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctc

SEQ ID NO: 122 - DNA, 2789 bp, Homo sapiens
  misc_feature: RLBP1 PROMOTER
ctcctcctcatccagtggaatagcaaaacagaggctgggaagttacctgttgagaggctgcagaggggtttcttcctgtacaaaggattgaataataagttccctccagttaggcacctattgatactgtatttggagtaactgacctttccagaggacttattgtcaggcagctaaacccctgaactaagcactttactgccatttcatccgcactaaagtcatgagcctggtcctctagttttctacacttcttagaggaggaaactgagccgatgagttttgaagtcatgtttcccggccagaagatgctcgagcgaggctttacaggcgggcagtctggttccagggcatgccactgcaccacactgcccagaaggaggctcagcctgtcttgtcctctccctgcttggccttaaccagccacatttctcaactgaccccactcactgcagaggtgaaaactaccatgccaggtcctgctggctgggggaggggtgggcaataggcctggatttgccagagctgccactgtagatgtagtcatatttacgatttcccttcacctcttattaccctggtggtggtggtgggggggggggggtgctctctcagcaaccccaccccgggatcttgaggagaaagagggcagagaaaagagggaatgggactggcccagatcccagccccacagccgggcttccacatggccgagcaggaactccagagcaggagcacacaaaggagggctttgatgcgcctccagccaggcccaggcctctcccctctcccctttctctctgggtcttcctttgccccactgagggcctcctgtgagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcaggtaagtcaatacctggggcttgcctgggccagggagcccaggactggggtgaggactcaggggagcagggagaccacgtcccaagatgcctgtaaaactgaaaccacctggccattctccaggttgagccagaccaatttgatggcagatttagcaaataaaaatacaggacacccagttaaatgtgaatttcagatgaacagcaaatacttttttagtattaaaaaagttcacatttaggctcacgcctgtaatcccagcactttgggaggccgaggcaggcagatcacctgaggtcaggagttcgagaccagcctggccaacatggtgaaaccccatctccactaaaaataccaaaaattagccaggcgtgctggtgggcacctgtagttccagctactcaggaggctaaggcaggagaattgcttgaacctgggaggcagaggttgcagtgagctgagatcgcaccattgcactctagcctgggcgacaagaacaaaactccatctcaaaaaaaaaaaaaaaaaaaaagttcacatttaactgggcattctgtatttaattggtaatctgagatggcagggaacagcatcagcatggtgtgagggataggcattttttcattgtgtacagcttgtaaatcagtatttttaaaactcaaagttaatggcttgggcatatttagaaaagagttgccgcacggacttgaaccctgtattcctaaaatctaggatcttgttctgatggtctgcacaactggctgggggtgtccagccactgtccctcttgcctgggctccccagggcagttctgtcagcctctccatttccattcctgttccagcaaaacccaactgatagcacagcagcatttcagcctgtctacctctgtgcccacatacctggatgtctaccagccagaaaggtggcttagatttggttcctgtgggtggattatggcccccagaacttccctgtgcttgctgggggtgtggagtggaaagagcaggaaatgggggaccctccgatactctatgggggtcctccaagtctctttgtgcaagttagggtaataatcaatatggagctaagaaagagaaggggaactatgctttagaacaggacactgtgccaggagcattgcagaaattatatggttttcacgacagttctttttggtaggtactgttattatcctcagtttgcagatgaggaaactgagacccagaaaggttaaataacttgctagggtcacacaagtcataactgacaaagcctgattcaaacccaggtctccctaacctttaaggtttctatgacgccagctctcctagggagtttgtcttcagatgtcttggctctaggtgtcaaaaaaagacttggtgtcaggcaggcataggttcaagtcccaactctgtcacttaccaactgtgactaggtgattgaactgaccatggaacctggtcacatgcaggagcaggatggtgaagggttcttgaaggcacttaggcaggacatttaggcaggagagaaaacctggaaacagaagagctgtctccaaaaatacccactggggaagcaggttgtcatgtgggccatgaatgggacctgttctggtaaccaagcattgcttatgtgtccattacatttcataacacttccatcctactttacagggaacaaccaagactggggttaaatctcacagcctgcaagtggaagagaagaacttgaacccaggtccaacttttgcgccacagcaggctgcctcttggtcctgacaggaagtcacaacttg

SEQ ID NO: 123 - DNA, 292 bp, Homo sapiens
  misc_feature: GRK1 specific promoter
gggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggtctcccaggggcttcccagtggtccccaggaaccctcgacagggcccggtctctctcgtccagcaagggcagggacgggccacaggccaagggc

SEQ ID NO: 124 - DNA, 516 bp, Homo sapiens
  misc_feature: RHO specific promoter
ccacgtcagaatcaaaccctcaccttaacctcattagcgttgggcataatcaccaggccaagcgccttaaactacgagaggccccatcccacccgccctgccttagccctgccacgtgtgccaaacgctgttagacccaacaccacccaggccaggtagggggctggagcccaggtgggcatttgagtcaccaacccccaggcagtctcccttttcctggatcctgagtacctctcctccctgacctcaggcttcctcctagtgtcaccttggcccctcttagaagccaattaggccctcagtttctgcagcggggattaatatgattatgaacacccccaatctcccagatgctgattcagccaggagcttaggagggggaggtcactttataagggtctgggggggtcagaacccagagtcatccagctggagccctgagtggctgagctcaggccttcgcagcattcttgggtgggagcagccacgggtcagccacaagggccaccaccatgg

SEQ ID NO: 125 - DNA, 22 bp, Artificial
  micro RNA target site
cagctatgccagcatcttgcct

SEQ ID NO: 126 - DNA, 22 bp, Artificial
  microRNA target site
cgcattattactcacggtacga

SEQ ID NO: 127 - DNA, 22 bp, Artificial
  microRNA target site
aggcataggatgacaaagggaa

SEQ ID NO: 128 - DNA, 56 bp, artificial
  synthetic intron
gtgagtatttttgatgtgaatatatataattttagcccttttttattatttaacag

SEQ ID NO: 129 - DNA, 55 bp, artificial
  synthetic polyadenylation region
aataaaatatctttattttcattacatctgtgtgttggttttttgtgtgagatct

SEQ ID NO: 130 - DNA, 49 bp, artificial
  5' untranslated region
tctggctaactagagaacccactgcttactggcttctcgagattccacc

SEQ ID NO: 131 - DNA, 151 bp, adeno-associated virus 2
  misc_feature: inverted terminal repeat
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatct

SEQ ID NO: 132 - DNA, 151 bp, adeno-associated virus 2
  misc_feature: inverted terminal repeat
agatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 133 - DNA, 257 bp, Artificial
  truncated CMV-promoter
gttgacattgattattgactagtacggtaaatggcccgcctggctgatgactcacggggatttccaagtctccaccccattgacgtcaatgggagtttgttttggcaccaaaatcaacgggactttccaaaatgtcgtaagatatccgccccattgacgcaaatgggcggtaggcgtgtacggtgggaggtctatataagcagagctctctggctaactagagaacccactgcttactggcttctcgagattccacc

The invention claimed is:

1. A method for treatment or prophylaxis of a retinal disorder due to mutations in a CRB1 gene, comprising administering an effective amount gene therapy vector comprising a nucleotide sequence encoding a Crumbs homologue-2 (CRB2) protein and at least one parvoviral inverted terminal repeat (ITR) sequence to a human subject in need thereof, wherein:
   (a) the gene therapy vector is an rAAV vector that is capable of transducing photoreceptor cells and Müller glia cells and having a capsid selected from the group consisting of rAAV5 capsid, rAAV9 capsid and ShH10Y capsid,
   (b) the nucleotide sequence encoding CRB2 is operably linked to an expression control element comprising a promoter that enables expression of CRB2 in photoreceptor cells and Müller glia cells, wherein said promoter is selected from the group consisting of truncated CMV and CMV, and
   (c) the gene therapy vector is administered subretinally to the human subject in need thereof;
   and wherein following administering of the gene therapy vector, CRB2 is expressed in photoreceptor cells and Müller glia cells.

2. A method according to claim 1, wherein the retinal disorder is Leber's congenital amaurosis or retinitis pigmentosa.

3. A method according to claim 2, wherein the retinal disorder is LCA8 or RP12.

4. A method according to claim 1, wherein the expression control element comprises a promoter selected from the group consisting of a CMV promoter according to SEQ ID NO:121 and a truncated CMV promoter according to SEQ ID NO:133.

* * * * *